(12) United States Patent
Janjic et al.

(10) Patent No.: US 9,994,857 B2
(45) Date of Patent: Jun. 12, 2018

(54) PDGF AND VEGF APTAMERS HAVING IMPROVED STABILITY AND THEIR USE IN TREATING PDGF AND VEGF MEDIATED DISEASES AND DISORDERS

(71) Applicant: SomaLogic, Inc., Boulder, CO (US)

(72) Inventors: Nebojsa Janjic, Boulder, CO (US); Daniel W. Drolet, Boulder, CO (US); Amy D. Gelinas, Lafayette, CO (US); Chi Zhang, Superior, CO (US); Michael Vrkljan, Mead, CO (US)

(73) Assignee: SOMALOGIC, INC., Boulder, CO (US)

( * ) Notice: Subject to any disclaimer, the term of this patent is extended or adjusted under 35 U.S.C. 154(b) by 0 days. days.

(21) Appl. No.: 15/594,921

(22) Filed: May 15, 2017

(65) Prior Publication Data

US 2017/0247702 A1    Aug. 31, 2017

Related U.S. Application Data

(62) Division of application No. 14/909,305, filed as application No. PCT/US2014/054561 on Sep. 8, 2014, now Pat. No. 9,695,424.

(60) Provisional application No. 61/875,660, filed on Sep. 9, 2013.

(51) Int. Cl.
   *C12N 15/115* (2010.01)

(52) U.S. Cl.
   CPC ........ *C12N 15/115* (2013.01); *C12N 2310/16* (2013.01); *C12N 2310/315* (2013.01); *C12N 2310/321* (2013.01); *C12N 2310/3341* (2013.01); *C12N 2310/344* (2013.01); *C12N 2310/346* (2013.01); *C12N 2320/51* (2013.01)

(58) Field of Classification Search
   CPC .................................................. C12N 15/115
   USPC ....................................................... 536/23.1
   See application file for complete search history.

(56) References Cited

U.S. PATENT DOCUMENTS

| | | |
|---|---|---|
| 4,711,955 A | 12/1987 | Ward |
| 4,737,453 A | 4/1988 | Primus et al. |
| 4,752,566 A | 6/1988 | Collins et al. |
| 5,270,163 A | 12/1993 | Gold et al. |
| 5,412,087 A | 5/1995 | McGall et al. |
| 5,580,972 A | 12/1996 | Tu |
| 5,582,981 A | 12/1996 | Toole et al. |
| 5,599,720 A | 2/1997 | Ekins et al. |
| 5,674,685 A | 10/1997 | Janjic et al. |
| 5,719,273 A | 3/1998 | Tu et al. |
| 5,723,394 A | 3/1998 | Janjic et al. |
| 5,723,594 A | 3/1998 | Janjic et al. |
| 5,731,144 A | 3/1998 | Toothman et al. |
| 5,731,424 A | 3/1998 | Toothman et al. |
| 5,811,533 A | 9/1998 | Gold et al. |
| 5,840,867 A | 11/1998 | Toole et al. |
| 5,849,479 A | 12/1998 | Janjic et al. |
| 5,859,228 A | 1/1999 | Janjic et al. |
| 5,874,218 A | 2/1999 | Drolet et al. |
| 5,945,527 A | 8/1999 | Tu et al. |
| 6,051,698 A | 4/2000 | Janjic et al. |
| 6,124,449 A | 9/2000 | Gold et al. |
| 6,168,788 B1 | 1/2001 | Wortham et al. |
| 6,207,816 B1 | 3/2001 | Gold et al. |
| 6,229,002 B1 | 5/2001 | Janjic et al. |
| 6,762,290 B1 | 7/2004 | Janjic et al. |
| 7,855,054 B2 | 12/2010 | Schneider et al. |
| 7,947,447 B2 | 5/2011 | Zichi et al. |
| 8,816,056 B2 | 8/2014 | Swayze et al. |
| 8,975,388 B2 | 3/2015 | Zichi et al. |
| 9,125,930 B2 | 9/2015 | De Franciscis et al. |
| 9,382,533 B2 | 7/2016 | Zichi et al. |
| 2003/0054360 A1 | 3/2003 | Gold et al. |
| 2004/0180360 A1 | 9/2004 | Wilson et al. |
| 2005/0096290 A1 | 5/2005 | Adamis et al. |
| 2006/0057573 A1 | 3/2006 | Gold et al. |
| 2007/0166741 A1 | 7/2007 | Heil et al. |
| 2009/0004667 A1 | 1/2009 | Zichi et al. |
| 2009/0042206 A1 | 2/2009 | Schneider et al. |
| 2010/0317120 A1 | 12/2010 | Heil et al. |
| 2011/0136099 A1 | 6/2011 | Schneider et al. |
| 2012/0207744 A1 | 8/2012 | Mendlein et al. |
| 2014/0249043 A1 | 9/2014 | Schneider et al. |
| 2015/0105452 A1 | 4/2015 | Jarvis et al. |
| 2015/0168388 A1 | 6/2015 | Heil et al. |
| 2016/0298118 A1 | 10/2016 | Jarvis et al. |

FOREIGN PATENT DOCUMENTS

| | | |
|---|---|---|
| CN | 1934255 B | 7/2012 |
| EP | 2483408 A2 | 8/2012 |
| JP | 2006-516151 | 6/2006 |

(Continued)

OTHER PUBLICATIONS

Davies et al., "Unique motifs and hydrophobic interactions shape the binding of modified DNA ligands to protein targets", PNAS, vol. 109, No. 49, pp. 19971-19976, published on Dec. 4, 2012.
DiDonato (2006) Dissertation. University of North Carolina, Raleigh.
DiDonato (2006) "Dissertation. Part II. Synthesis and Evaluation of Modified Nucleotides for DNA Aptamer Selection" University of North Carolina, Raleigh 26-52 [NOTE: Entire Paper Submitted to PTO].
Drolet et al. (Aug. 1996) Nature Biotechnology 14(8):1021-1025, "An enzyme-linked oligonucleotide assay".
EP Search Report issued in EP 13767724.1 dated Sep. 28, 2015.
Gold et al. (Dec. 7, 2010) PLOS ONE 5(12):1-17, (e15004), "Aptamer-Based Multiplexed Proteomic Technology for Biomarker Discovery".

(Continued)

*Primary Examiner* — Jezia Riley
(74) *Attorney, Agent, or Firm* — Swanson & Bratschun, L.L.C.

(57) ABSTRACT

Aptamers having improved stability against nucleases that bind PDGF and aptamers that bind VEGF are provided. In addition, aptamer constructs comprising a PDGF aptamer and a VEGF aptamer are provided. Pharmaceutical compositions comprising the aptamers and aptamer constructs are provided, as well as methods of treating conditions using the aptamers and aptamer constructs.

3 Claims, 38 Drawing Sheets

(56) References Cited

FOREIGN PATENT DOCUMENTS

| | | |
|---|---|---|
| WO | WO 1991/16901 A1 | 11/1991 |
| WO | WO 1992/11389 A1 | 7/1992 |
| WO | WO 1996/027604 | 9/1996 |
| WO | WO 1996/38579 | 12/1996 |
| WO | WO 2000/058451 A1 | 10/2000 |
| WO | WO 2001/066719 A1 | 9/2001 |
| WO | WO 2002/058786 | 8/2002 |
| WO | WO 2004/045543 A2 | 6/2004 |
| WO | WO 2004/047742 | 6/2004 |
| WO | WO 2004/064760 A2 | 8/2004 |
| WO | WO 2004/067765 A2 | 8/2004 |
| WO | WO 2004/094614 A2 | 11/2004 |
| WO | WO 2005/020972 A2 | 3/2005 |
| WO | WO 2005/052121 | 6/2005 |
| WO | WO 2005/062881 A2 | 7/2005 |
| WO | WO 2005/071059 A2 | 8/2005 |
| WO | WO 2006/050498 | 5/2006 |
| WO | WO 2009/012410 | 1/2009 |
| WO | WO 2011/006075 | 1/2011 |
| WO | WO 2011/034935 A2 | 3/2011 |
| WO | WO 2011/130065 A1 | 10/2011 |
| WO | WO 2011/130195 | 10/2011 |
| WO | WO 2013/064702 A2 | 5/2013 |
| WO | WO 2013/149086 A1 | 10/2013 |

OTHER PUBLICATIONS

Gold et al. (Jan. 1, 1995) Harvey Lectures 91:47-57, "The SELEX Process: A Surprising Source of Therapeutic and Diagnostic Compounds".
Gold et al. (Jan. 1995) Annual Review of Biochemistry 64:763-797, "Diversity of Oligonucleotide Functions".
Green, L.S., et al. (1996) Biochemistry 35:14413-14424, "Inhibitory DNA Ligands to Platelet-Derived Growth Factor B-Chain".
International Search Report and Written Opinion dated Jul. 3, 2013 in PCT/US2013/034493.
International Preliminary Examination Report on Patentability dated Oct. 1, 2014 in PCT/US2013/034493.
International Preliminary Report on Patentability dated Dec. 9, 2014 in PCT/US2013/044792.
International Preliminary Report on Patentability dated Mar. 24, 2016 in PCT/US2014/054561.
International Search Report and Written Opinion dated Feb. 11, 2015 in PCT/US2014/054561.
Jayasena (1999) Clinical Chemistry 45(9):1628-1650 "Aptamers: An Emerging Class of Molecules That Rival Antibodies in Diagnostics".
Jellinek, et al. (Aug. 30, 1994) Biochemistry 33(34):10450-10456, "Inhibition of Receptor Binding by High-Affinity RNA Ligands to Vascular Endothelial Growth Factor".
Mayer, G. et al. (Mar. 2009) Angew. Chem Int. Ed. 48(15):2672-2689, "The Chemical Biology of Aptamers".
McGown et al. (Nov. 1995) Anal. Chem. 67:663A-668A, "The Nucleic Acid Ligand. A New Tool for Molecular Recognition".
Nobuo et al. (Jun. 2006) American Journal of Pathology 168(6):2036-2053, "Inhibition of platelet-derived growth factor B signaling enhances the efficacy of anti-vascular endothelial growth factor therapy in multiple models of ocular neovascularization".
Nonaka et al. (Jan. 7, 2010) Molecules 15(1):215-225, "Screening and improvement of an Anti-VEGF DNA Aptamer".
Office Action dated Aug. 17, 2015 in U.S. Appl. No. 14/381,679.
Office Action dated Dec. 23, 2015 in U.S. Appl. No. 14/381,679.
Ohuchi et al. (2006) Biochimie 88:897-904, "Selection of RNA aptamers against recombinant transforming growth factor-β type III receptor displayed in cell surface".
Osborne et al. (1997) Current Opinion in Chemical Biology 1:5-9, "Aptamers as Therapeutic and Diagnostic Reagents: Problems and Prospects".
Ostendorf (1999) Med Klin 94(4):219-223 Aptamers: a Novel Approach to Intervention Studies and the Development of Novel Therapeutic Approaches (with English Abstract).
Response to Office Action dated Aug. 19, 2015 in U.S. Appl. No. 14/381,679.
Response to Office Action dated Jan. 27, 2016 in U.S. Appl. No. 14/381,679.
Ruckman et al. (Aug. 7, 1998) J. Biol. Chem. 273(32):20556-20567, "2-Fluoropyrimidine RNA-based Aptamers to the 165-Amino Acid Form of Vascular Endothelial Growth Factor (VEGF$^{165}$). Inhibition of Receptor Binding and VEGF-induced Vascular Permeability through Interactions Requiring the Exon 7-Encoded Domain".
Vaught et al. (2004) J.Am. Chem. Soc. 126:11231-11237, "T7 RNA Polymerase Transcription and 5-Position Modified UTP Derivatives".
Vaught et al. (Mar. 2010) J.Am. Chem. Soc. ePub, 132(12):4141-4151:4142, "Expanding the Chemistry of DNA for In Vitro Selection".
Vaught, Jonathan David, Thesis Oct. 2008, "Enhancing the Functionality of Nucleic Acids".
Zhou et al. (2006) Anal. Bioanal. Chem. 384(5):1175-1180, "Detection of oncoprotein platelet-derived growth factor using a fluorescent signaling complex of an aptamer and TOTO".
Zichi et al. (Mar. 7, 2008) Current Opinion in Chemical Biology 12(1):78-85, "Proteomics and diagnostics: Let's Get Specific, again".
Extended European Search Report dated Jun. 29, 2017 in EP 14842475.7.

Fig. 1C    K_d Ratio

| 5-dU Modification | Bn-dU1 | Bn-dU2 | Bn-dU7 | Bn-dU8 | Bn-dU16 | Bn-dU17 | Bn-dU18 | Bn-dU20 |
|---|---|---|---|---|---|---|---|---|
| Bn-dU   | 1   | 1   | 1   | 1   | 1   | 1   | 1   | 1   |
| iB-dU   | 0.4 | 0.7 | 0.8 | 0.4 | 0.3 | 16  | 6.2 | 8.7 |
| Th-dU   | 0.5 | 1.5 | 1.2 | 0.9 | 0.5 | 0.7 | 0.5 | 0.9 |
| FBn-dU  | 0.3 | 0.5 | 0.3 | 0.7 | 0.8 | 3.1 | 1   | 0.5 |
| Pe-dU   | 1.7 | 1.8 | 0.8 | 2.1 | 1.5 | 0.5 | 1.1 | 1.5 |
| PP-dU   | 0.3 | 1.1 | 0.8 | 1.9 | 0.9 | 13  | 106 | 1.9 |
| Tyr-dU  | 0.2 | 2.5 | 1   | 33  | 1.2 | 34  | 4.4 | 1.9 |
| MBn-dU  | 0.6 | 0.3 | 0.9 | 3.6 | 1.4 | 7.1 | 7.6 | 0.5 |
| Nap-dU  | 0.9 | 1.3 | 1.4 | 3.3 | 1.1 | 4.6 | 27  | 0.9 |
| 2Nap-dU | 0.3 | 0.4 | 0.5 | 601 | 0.2 | 106 | 34  | 2.4 |
| NE-dU   | 0.3 | 3.1 | 0.6 | 17  | 1.4 | 38  | 51  | 0.3 |
| 2NE-dU  | 0.3 | 3.8 | 0.6 | 121 | 1.3 | 188 | 21  | 3.4 |
| Trp-dU  | 0.3 | 3.1 | 1.1 | 233 | 153 | 307 | 61  | 0.8 |
| BT-dU   | 0.6 | 2.9 | 1.9 | 35  | 4   | 30  | 113 | 1.8 |

Fig. 1D  Relative PDGFRβ Phosphorylation

| 5-dU Modification | BndU1 | BndU2 | BndU7 | BndU8 | BndU16 | BndU17 | BndU18 | BndU20 |
|---|---|---|---|---|---|---|---|---|
| Bn-dU   | 1 | 1  | 1 | 1  | 1   | 1   | 1  | 1  |
| iB-dU   | 1 | 3  | 1 | 44 | 1   | 81  | 21 | 25 |
| Th-dU   | 1 | 3  | 1 | 2  | 1   | 2   | 1  | 3  |
| FBn-dU  | 2 | 2  | 3 | 2  | 2   | 4   | 2  | 2  |
| Pe-dU   | 1 | 1  | 1 | 9  | 5   | 1   | 4  | 1  |
| PP-dU   | 4 | 2  | 1 | 17 | 1   | 42  | 57 | 5  |
| Tyr-dU  | 1 | 22 | 2 | 59 | 4   | 59  | 28 | 3  |
| MBn-dU  | 1 | 1  | 2 | 9  | 3   | 21  | 32 | 10 |
| Nap-dU  | 1 | 3  | 3 | 24 | 4   | 5   | 51 | 1  |
| 2Nap-dU | 1 | 1  | 1 | 90 | 3   | 82  | 60 | 8  |
| NE-dU   | 4 | 29 | 3 | 66 | 8   | 76  | 63 | 1  |
| 2NE-dU  | 3 | 41 | 3 | 82 | 10  | 92  | 68 | 16 |
| Trp-dU  | 1 | 3  | 1 | 63 | 9   | 100 | 21 | 2  |
| BT-dU   | 2 | 12 | 1 | 54 | 7   | 74  | 72 | 4  |

Fig. 2A

| Nucleotide | SOMAmer Intramolecular Contacts | SOMAmer-PDGF Contacts | # Contact Atoms |
|---|---|---|---|
| BndU1 | πτπ: U1-Bn2<br>vW: Bn2-Bn6; Bn2-Bn7<br>H-bonds: U1-V39; U1-R56 (2) | vW, chain 1: Glu24, Arg27, Leu38, Val39, Trp40, Pro42<br>vW, chain 2: Cys52*, Cys53, Asn54, Asn55, Arg56<br>H-bonds (3): U1-Val39 (1) & U1-Arg56 (2) | 24 |
| BndU2 | πτπ: U2-A3; Bn2-U1<br>vW: Bn2-Bn6, Bn2-Bn7<br>H-bonds: U2-BndU8 (2) | vW, chain 1: Arg27, Ala35, Asn36, Phe37, Leu38, Ile77<br>vW, chain 2: Asn54 | 12 |
| 2'OMe A3 | H-bonds: A3-U12 basepair | vW, chain 1: Asn36 | 1 |
| BndU7 | πτπ: U7-G6, U7-U8<br>vW: Bn7-Bn2; Bn7-Bn16<br>H-bonds: U7-A3 basepair | vW, chain 2: Asn54, Asn55 | 3 |
| BndU8 | πτπ: U8-Bn20, Bn8-Bn16, Bn8-Bn20<br>H-bonds: U8-BndU2 (2) | vW, chain 1: Leu38, Ile75, Lys80 | 3 |
| BndU16 | πτπ: U16-G15, U16-U17<br>vW: Bn16-Bn7, Bn16-Bn8, Bn16-PE17<br>H-bonds: U16-A9 basepair | πτπ: Bn16-Trp40<br>vW, chain 1: Arg73 | 4 |
| PEdU17 | πτπ: U17-U16<br>vW: PE17-Bn8, PE17-Th18<br>H-bonds: U17-BndU20 linker | vW, chain 1: Leu38, Val39, Trp40, Arg73, Ile75, Phe84<br>H-bond (1): PEdU17 linker-Arg73<br>Charge-charge (1): non-bridging O to Arg73 | 18 |
| ThdU18 | vW: Th18-PE17, Th18-U17 | vW, chain 1: Lys85, Lys86, Arg73, Phe84, Pro82, Lys74, Ile75 | 15 |
| dA19 | πτπ: A19-sugar18<br>vW: sugar19-U20 backbone | vW, chain 1: Ile83, Pro82, Phe84<br>H-bonds (2): A19 N3-Phe84 NH & A19 N6H-Phe84 C=O | 5 |
| BndU20 | πτπ: U20-A9, Bn20-U8, Bn20-Bn8<br>H-bonds: BndU20 linker-U17 N3 | vW, chain 1: Ile77, Lys80, Pro82, Phe84 | 11 |

Fig. 5A

| SOMAmer | SOMAmer | PDGF-BB +tRNA | PDGF-BB | PDGF-AB +tRNA | PDGF-AB | PDGF-AA +tRNA | PDGF-AA | PDGF-CC +tRNA | PDGF-CC | PDGF-DD +tRNA | PDGF-DD |
|---|---|---|---|---|---|---|---|---|---|---|---|
| | | | | | $K_d$ (nM) | | | | | | |
| 4149-8_38 | SL1 | 0.02 | 0.06 | 0.08 | 6.0 | >1000 | 1.6 | >1000 | >1000 | >1000 | 100 |
| 4149-8_130 | SL3 | 0.02 | 0.05 | 0.24 | 1.6 | >1000 | 8.7 | >1000 | >1000 | >1000 | 290 |
| 4149-8_255 | SL4 | 0.43 | 1.2 | 2.0 | 25 | 460 | 3.4 | >1000 | >1000 | >1000 | >1000 |
| 4149-8_260 | SL5 | 0.02 | 0.13 | 0.08 | 3.9 | 420 | 8.0 | >1000 | >1000 | 710 | >1000 |

Fig. 5B

```
PDGF Family Alignment
PDGF-B  SLGSLTIAEPAMIAECKTRTEVFEISRRLIDRTNANFLVWPPCVEVQRCSGCCNNVQCRPTQVQLRPV   70
PDGF-A  SIEEAVPAVCKTRTVIYEIPRSQVDPTSANFLIWPPCVEVKRCTGCCNTSSVKCQPSRVHHRSV
PDGF-C  VVDLNLLTEEVRLYSCTPRNFSVSIR EELKRTDIFWPGCLLVKRCGGNCACCLHNCNECQCVPSKV
PDGF-D  SYHDRKSKVDLDRLNDDAKRYSCTPRNYSVNIR EELKLANVFFPRCLLVQRCGGNCGGTVNWRSCTCNSGKT PDGF-B  QVSLQPLIEEVRQKP ATVTLEDHLACKCETVAAARPVTRSPGGSQEQRAKTPQTRVTIRT
PDGF-A  KVAKVEYVRKKP    KLKEVQVRLEEHLECACATTSLN PDYREEDTGRPRES
PDGF-C  TKKYHEVLQLRP    KTGVRGLAKSLTDVALEHHEECDCVCRGST GG  (SEQ ID NO: 842)
PDGF-D  VKKYHEVLQFEPGHIKRRGRAKTMALVDIQLEHHERCDCICSSRP   PR  (SEQ ID NO: 843)

PDGF-B  VRVRRPPKGKHRKFKHTHDKTALKETLGA  (SEQ ID NO: 840)
PDGF-A  GKRKRKR LKPT  (SEQ ID NO: 841)

PDGF-A: bold: residues involved in propeptide binding
PDGF-B: bold: residues involved in receptor binding
```

Fig. 6A

| C3 Linker Substitution (K_d ratio) | Position # 5′ | | | | | | | | | | | | | | | | | | | | | | | | 3′ | PDGF BB K_d(nM) | PDGF AB K_d(nM) | Cellular IC_50(nM) |
|---|---|---|---|---|---|---|---|---|---|---|---|---|---|---|---|---|---|---|---|---|---|---|---|---|---|---|---|---|
| | | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | | | |
| SL1 | | Bn | Bn | A | C | G | G | Bn | Bn | A | C | A | C | G | G | G | Bn | Bn | Bn | A | Bn | A | C | G | G | 0.02 | 0.06 | 0.2 |
| SL2 | | Bn | Bn | A | C | A | G | Bn | Bn | A | C | A | C | G | G | G | Bn | Bn | Bn | A | Bn | A | G | C | G | 0.02 | ND | 0.3 |
| SL3 | | Bn | Bn | mAC | | C | G | Bn | Bn | A | mAC | | C | G | G | G | Bn | Bn | Bn | A | Bn | mAG | | C | mG | 0.05 | 0.19 | 0.3 |

Position 5 substitutions (K_d ratio): Bn=1.1, A=0.9, C=0.9, HEG linker=0.8, HEG linker=0.8, G=0.8

K_d ratios by position: 32, 5700, 1200, 96, (0.8–1.1 variants at 5), 390, 10000, 13000, 30000, 280, 2.2, 3.1, 610, 4300, 30000, 30000, 9200, 30000, 34, 7600, 30000, 4600, 190, 1.5

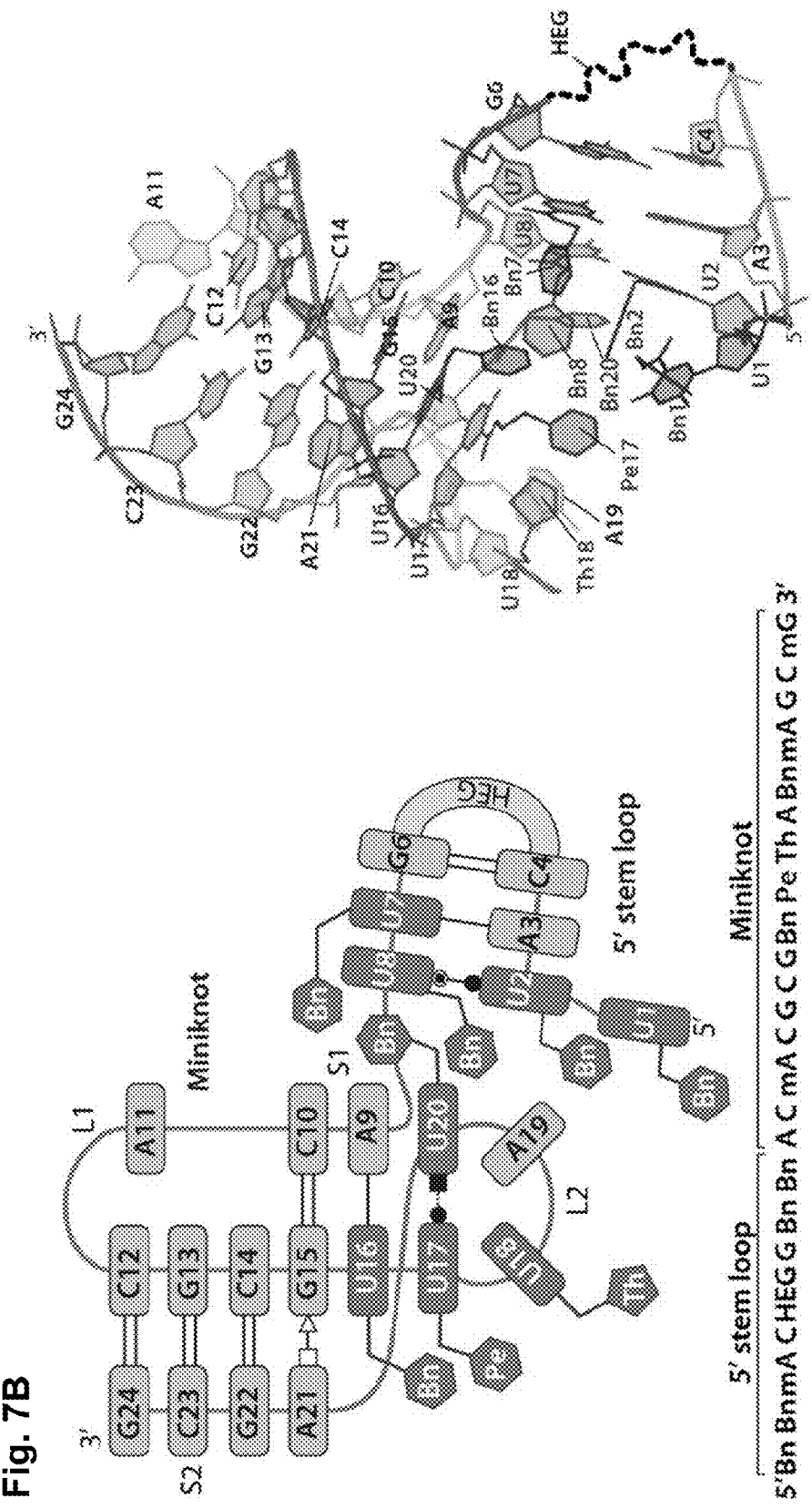

Fig. 10A
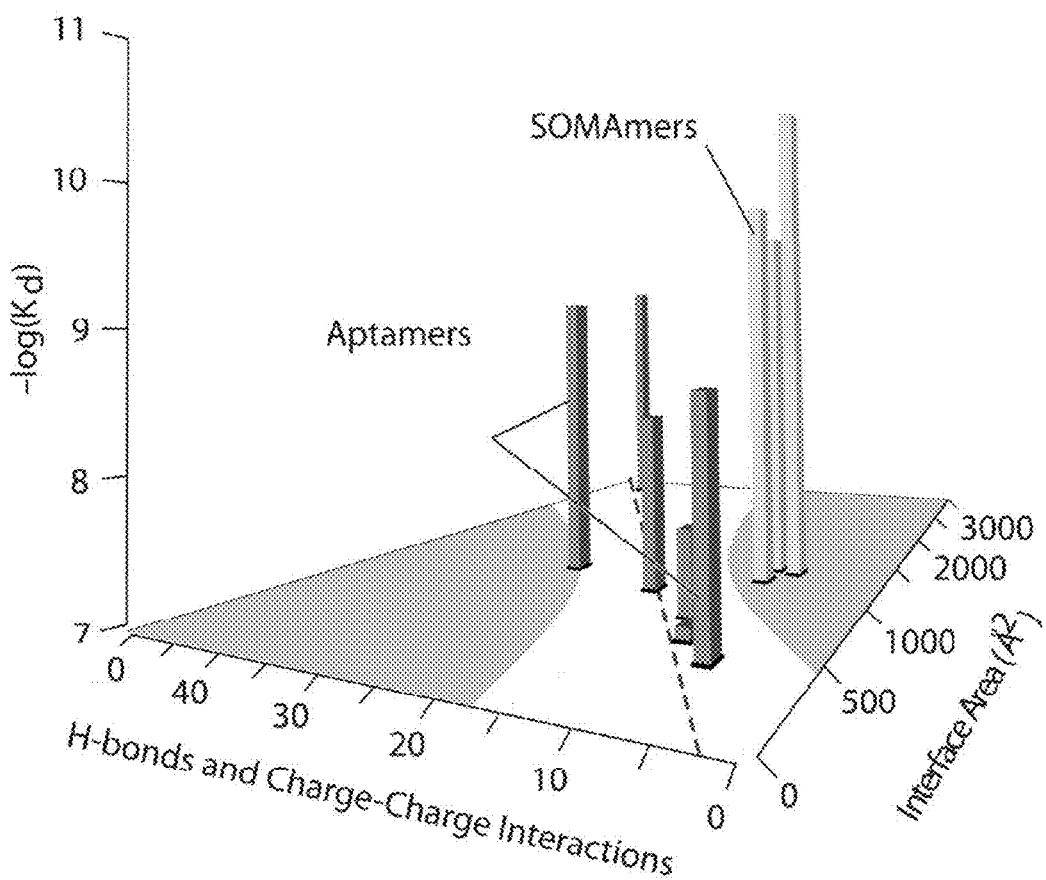
Fig. 10B
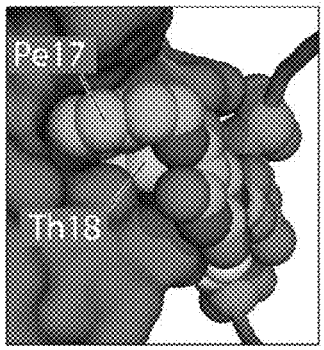
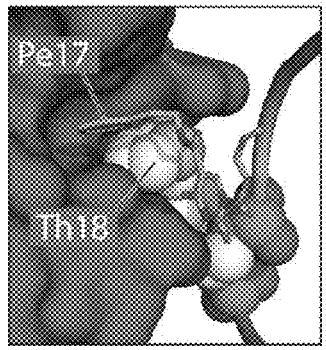
Fig. 10C
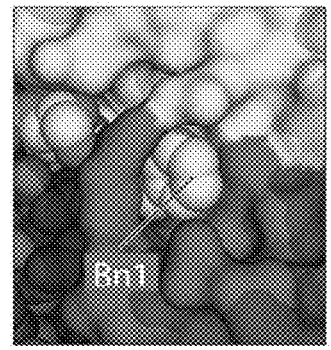

Base = Uridine (U) or Cytidine(C) (attachment is to the 5-position)
K = R' group plus $(CH_2)_n$ connecting group, where n = 0-3

*Denotes point of attachment of the R' group to $(CH_2)_n$ connecting group

Fig. 12 Continued wherein

R'''' is selected from the group consisting of a branched or linear lower alkyl (C1-C20); hydroxyl (OH), halogen (F, Cl, Br, I); nitrile (CN); boronic acid ($BO_2H_2$); carboxylic acid (COOH); carboxylic acid ester (COOR''); primary amide ($CONH_2$); secondary amide (CONHR''); tertiary amide (CONR''R'''); sulfonamide ($SO_2NH_2$); N-alkylsulfonamide (SONHR'');

wherein

R'', R''' are independently selected from a group consisting of a branched or linear lower alkyl (C1-C2)); phenyl (C6H5); an R'''' substituted phenyl ring (R''''C6H4); wherein R'''' is defined above; a carboxylic acid (COOH); a carboxylic acid ester (COOR''''); wherein R'''' is a branched or linear lower alkyl (C1-C20); and cycloalkyl; wherein R'' = R''' = (CH2)n;

wherein n =2-10.

Fig. 14

| Position | 1 | 2 | 3 | 4 | 5 | 6 | 7 | 8 | 9 | 10 | 11 | 12 | 13 | 14 | 15 | 16 | 17 | 18 | 19 | 20 | 21 |
|---|---|---|---|---|---|---|---|---|---|---|---|---|---|---|---|---|---|---|---|---|---|
| Consensus | V | R | M | S | N | N | V | K | P | G | P | A | P | G | V | A | V | R | P | C | P |
| Frequencies | | | | | | | | | | | | | | | | | | | | | |
| A | 0.18 | 0.14 | 0.80 | 0.04 | 0.67 | 0.20 | 0.35 | 0.78 | 0.00 | 0.00 | 0.00 | 1.00 | 0.00 | 0.00 | 0.29 | 0.92 | 0.14 | 0.86 | 0.00 | 0.00 | 0.04 |
| C | 0.39 | 0.02 | 0.10 | 0.78 | 0.10 | 0.12 | 0.51 | 0.12 | 0.02 | 0.02 | 0.00 | 0.00 | 0.00 | 0.00 | 0.55 | 0.08 | 0.63 | 0.00 | 0.02 | 0.98 | 0.00 |
| G | 0.27 | 0.78 | 0.04 | 0.10 | 0.14 | 0.59 | 0.10 | 0.06 | 0.06 | 0.98 | 0.00 | 0.00 | 0.00 | 0.96 | 0.10 | 0.00 | 0.18 | 0.10 | 0.00 | 0.00 | 0.00 |
| P | 0.04 | 0.00 | 0.02 | 0.06 | 0.10 | 0.04 | 0.04 | 0.04 | 0.92 | 0.00 | 1.00 | 0.00 | 1.00 | 0.04 | 0.06 | 0.00 | 0.06 | 0.04 | 0.98 | 0.02 | 0.96 |

Nucleotide position and consensus sequence for the 5169-4 aptamer family is shown in top two rows. Rows A, C, G and P (where P is Nap-dU) indicate the frequency at which these nucleotides are observed in the 5169-4 aptamer family at each of the 21 positions that define the minimal sequence required for high affinity binding. In the consensus sequence, multiple nucleotide consensus is indicated with the following single letter code: R = A or G; M = A or C; K = G or P; V = A, C, or G; N = any nucleotide.

Fig. 15

| Mod | Nap-dU4 | Nap-dU5 | Nap-dU10 | Nap-dU13 | Nap-dU14 | Nap-dU16 | Nap-dU21 | Nap-dU22 | Nap-d23 | Nap-dU27 |
|---|---|---|---|---|---|---|---|---|---|---|
| Nap-dU | 1 | 1 | 1 | 1 | 1 | 1 | 1 | 1 | 1 | 1 |
| iBu-dU | 1700 | 1900 | 110 | 28 | 20800 | 13 | 25 | 20800 | 1050 | 20800 |
| Trp-dU | 135 | 45 | 18 | 20800 | 870 | 15 | 180 | 81 | 16 | 1.4 |
| FBn-dU | 28 | 4 | 8.3 | 12 | 130 | 3.9 | 28 | 210 | 42 | 20800 |
| 2Nap-dU | 13 | 20800 | 12 | 37 | 63 | 72 | nd | 20 | 27 | 420 |
| PE-dU | 340 | 130 | 57 | 44 | 170 | 7.3 | 210 | 34 | 350 | 240 |
| Tyr-dU | 20800 | 13000 | 42 | 210 | 2900 | 50 | 570 | 1600 | 38 | 64 |
| NE-dU | 85 | 10 | 8 | 17 | 23 | 1.3 | 51 | 34 | 30 | 1850 |
| 2NE-dU | 59 | 97 | 164 | 91 | 490 | 13 | 1020 | 190 | 48 | 330 |
| MBn-dU | 140 | 78 | 1 | 9.6 | 56 | 4.1 | 20800 | 2.4 | 19 | 540 |
| PP-dU | 110 | 59 | 67 | 20 | 337 | 34 | 57 | 1800 | 20800 | 20800 |
| Th-dU | 300 | 370 | 8.9 | 67 | 510 | 4.6 | 169 | 157 | 23 | 20800 |
| BT-dU | 14 | 23 | 4.8 | 26 | 28 | 1.3 | 170 | nd | 16 | 130 |
| Bn-dU | nd | nd | nd | 8.3 | nd | nd | 34 | 74 | 61 | 310 |
| MOE-dU | 20800 | 20800 | 20 | 1440 | 20800 | 38 | 140 | 586 | 1040 | 20800 |
| R(-)THF-dU | 840 | 110 | 300 | 6090 | 24 | 110 | 1700 | 960 | 20800 | nd |
| S(+)THF-dU | 20800 | 3700 | 290 | 120 | 20800 | 40 | 440 | 20800 | 740 | 20800 |
| BF-dU | 1600 | 210 | 20800 | 180 | 225 | 104 | 3600 | 41 | 75 | 7900 |

Fig. 16

| Position | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|
| Consensus | C | C | G | N | N | C | A | A | G | N | G | C | N | N | G | N | A | G | G | A | N | N | N | A | A | A | N | G | G |
| Frequencies | | | | | | | | | | | | | | | | | | | | | | | | | | | | | |
| A | 0.00 | 0.00 | 0.01 | 0.00 | 0.00 | 0.00 | 0.99 | 1.00 | 0.00 | 0.00 | 0.01 | 0.00 | 0.00 | 0.00 | 0.00 | 0.00 | 0.99 | 0.00 | 0.00 | 1.00 | 0.00 | 0.00 | 0.00 | 1.00 | 1.00 | 1.00 | 0.00 | 0.00 | 0.00 |
| C | 0.99 | 1.00 | 0.00 | 0.00 | 0.00 | 1.00 | 0.00 | 0.00 | 0.00 | 0.01 | 0.00 | 0.99 | 0.00 | 0.00 | 0.00 | 0.00 | 0.00 | 0.00 | 0.00 | 0.00 | 0.00 | 0.00 | 0.00 | 0.00 | 0.00 | 0.00 | 0.01 | 0.00 | 0.00 |
| G | 0.00 | 0.00 | 0.99 | 0.00 | 0.00 | 0.00 | 0.00 | 0.00 | 1.00 | 0.00 | 0.99 | 0.00 | 0.00 | 0.00 | 0.99 | 0.00 | 0.01 | 1.00 | 1.00 | 0.00 | 0.00 | 0.00 | 0.00 | 0.00 | 0.00 | 0.00 | 0.00 | 1.00 | 1.00 |
| T/Z | 0.01 | 0.00 | 0.00 | 1.00 | 1.00 | 0.00 | 0.00 | 0.00 | 0.00 | 0.99 | 0.00 | 0.00 | 1.00 | 0.99 | 0.00 | 1.00 | 0.00 | 0.00 | 0.00 | 0.00 | 1.00 | 1.00 | 1.00 | 0.00 | 0.00 | 0.00 | 0.99 | 0.00 | 0.00 |

Nucleotide position and consensus sequence for the 4867-31 aptamer family is shown in top two rows. Rows A, C, G and T/Z indicate the frequency at which these nucleotides are observed in the 4867-31 aptamer family at each of the 29 conserved positions.

Fig. 22C

| | Protein Target | -Log ($K_d$) | -ΔG (kcal/mol) | Contact Atoms | Polar Contacts | Interface Area (Å²) | Ligand Efficiency (kcal/mol per contact atom) | References | PDB Code |
|---|---|---|---|---|---|---|---|---|---|
| Aptamers | MS2 coat protein | 8.6 | 11.6 | 25 | 6 | 348 | 0.464 | (a) | 6MSF |
| | IgG | 7.1 | 9.7 | 37 | 9 | 477 | 0.262 | (b) | 3AGV |
| | Thrombin | 7.6 | 10.3 | 62 | 11 | 657 | 0.166 | (c) | 3QLP |
| | NFκB | 8.3 | 11.2 | 57 | 17 | 870 | 0.196 | (d) | 1OOA |
| | vWF | 9.2 | 12.5 | 109 | 27 | 1011 | 0.115 | (e) | 3HXO |
| | GlnRS | 9.6 | 13.0 | 203 | 42 | 2599 | 0.064 | (f) | 1EXD |
| | PDGF-BB | 10.7 | 15.2 | 131 | 7 | 1225 | 0.116 | (g) | 4HQU |
| SOMAmers | Target 1 | 9.9 | 14.0 | 78 | 9 | 1097 | 0.180 | (g) | |
| | Target 2 | 9.7 | 13.7 | 75 | 9 | 1248 | 0.183 | (g) | |

PDGF AND VEGF APTAMERS HAVING IMPROVED STABILITY AND THEIR USE IN TREATING PDGF AND VEGF MEDIATED DISEASES AND DISORDERS

CROSS REFERENCE TO RELATED APPLICATIONS

This application is a divisional of U.S. application Ser. No. 14/909,305, filed Feb. 1, 2016. U.S. application Ser. No. 14/909,305 is a 35 U.S.C. § 371 national phase application of International Application Serial No. PCT/US2014/054561 (WO 2015/035305), filed Sep. 8, 2014. International Application Serial No. PCT/US2014/054561 claims priority to U.S. Provisional Application Ser. No. 61/875,660, filed Sep. 9, 2013, which application is incorporated by reference in its entirety.

The instant application contains a Sequence Listing which has been filed electronically in ASCII format and is hereby incorporated by reference in its entirety. Said ASCII copy, created on Jan. 19, 2018, is named Sequence_Listing_0057_62PCT-US2_ST25.txt and is 1,033,573 bytes in size.

FIELD OF THE INVENTION

The present disclosure relates generally to the field of nucleic acids and more particularly to aptamers capable of binding to platelet-derived growth factor (PDGF) and aptamers capable of binding to vascular endothelial growth factor (VEGF). In some embodiments, such aptamers are useful as therapeutics for preventing, treating, and/or ameliorating proliferative disorders, including, but not limited to, atherosclerosis, macular degeneration, fibrosis, cancer, and other disorders in which PDGF and/or VEGF has been implicated. In some embodiments, the present disclosure relates to aptamer constructs that are capable of binding to VEGF and PDGF, either simultaneously or in a mutually exclusive manner, and are useful as therapeutics.

BACKGROUND

The following description provides a summary, of information, and is not an admission that any of the information provided or publications referenced herein is prior art to the present disclosure.

Platelet-derived growth factors (PDGF-A, -B, -C and -D) are ubiquitous mitogens and chemotactic factors for many connective tissue cells (Fredriksson, L., et al. (2004) Cytokine Growth Factor Rev. 15(4):197). PDGFs occur as disulfide-linked dimers and contain a cysteine-knot-fold growth factor domain that functions through binding to PDGF receptors α and β on the surface of a cell (Claesson-Welsh, L., et al. (1989) Proc. Natl. Acad. Sci. USA 86:4917). PDGF binding induces receptor dimerization, which leads to autophosphorylation at intracellular tyrosine residues (Claesson-Welsh, J. (1994) Biol. Chem. 269:32023). PDGF-BB is involved in several proliferative disorders, including atherosclerosis, fibrosis, macular degeneration, and cancer (Östman, A., et al. (2001) Adv. Cancer Res. 80:1; Appelmann, I., et al. (2010) Recent Results Cancer Res. 180:51; Trojanowska, M., et al. (2008) Rheumatology (Oxford) 47(Suppl 5):2; Rutherford et al. (1997) Atherosclerosis 130:45; Smits et al. (1992) Am. J. Pathol. 140:639; Heldin et al. (1991) Endocrinology 129:2187; Floege and Johnson (1995) Miner. Electrolyte Metab. 21:271; Raines et al. (1990) *Experimental Pharmacology, Peptide Growth Factors and Their Receptors*, Sporn & Roberts, pp. 173-262, Springer, Heidelberg.).

VEGF is a secreted disulfide-linked homodimer that selectively stimulates endothelial cells to proliferate, migrate and produce matrix-degrading enzymes, all of which are processes required for the formation of new blood vessels (Conn, G., et al. (1990) Proc. Natl. Acad. Sci. USA 87:1323; Ferrara, N. et al. (1989) Biochem. Biophys. Res. Commun. 161:851; Gospodarowicz, D., et al. (1989) Proc. Natl. Acad. Sci. USA 86:7311; Pepper, M. S., et al. (1991) Biochem. Biophys. Res. Commun. 181:902; Unemori, E. N., et al. (1992) J. Cell. Physiol. 153:557). In addition to being the only known endothelial cell-specific mitogen, VEGF is unique among angiogenic growth factors in its ability to induce a transient increase in blood vessel permeability to macromolecules (Dvorak, H. F., et al. (1979) J. Immunol. 122:166; Senger, D. R., et al. (1983) Science 219:983; Senger, D. R., et al. (1986) Cancer Res. 46:5629). Increased vascular permeability and the resulting deposition of plasma proteins in the extravascular space facilitate new vessel formation by providing a provisional matrix for the migration of endothelial cells. Hyperpermeability is indeed a characteristic feature of new vessels (Dvorak, H. F., et al. (1995) Am. J. Pathol. 146:1029). Furthermore, compensatory angiogenesis induced by tissue hypoxia is also mediated by VEGF (Levy, A. P., et al. (1996) J. Biol. Chem. 271:2746; Shweiki, D., et al. (1991) Nature 359:843). The identification of VEGF as a hypoxia-inducible protein, along with the complementary observation that hyperoxia causes suppression of VEGF expression, provides an appealing mechanism for matching oxygen demand with vascular supply (Benjamin, L. E., et al. (1999) J. Clin. Invest. 103:159; Alon, T., et al. (1995) Nat. Med. 1:1024).

Several isoforms of VEGF protein occur as a result of alternative splicing of the eight exons of the gene that encodes VEGF (Eming, S. A., et al. (2006) J. Invest. Dermatol. Symp. Proc. 11:79). The most prevalent isoforms are VEGF-121, VEGF-165 and VEGF-189. Proteolytic processing of VEGF can generate additional isoforms. VEGF-165 can be cleaved by plasmin between Arg-110 and Ala-111 to generate VEGF-110, which is functionally equivalent to VEGF-121 (Keyt, B. A., et al. (1996) J. Biol. Chem. 271:7788). VEGF-189 can be cleaved by urokinase within the exon 6 domain and then can be cleaved further by plasmin to generate VEGF-110 (Plouet, J., et al., (1997) J. Biol. Chem. 272:13390). In addition, a subset of matrix metalloproteases (MMPs), including MMP-3, -7, -9 and -19, are capable of cleaving VEGF-165 and VEGF-189 in sequential steps to generate VEGF-113, which is functionally equivalent to VEGF-110. Therefore, the relative abundance of matrix-bound and diffusible forms of VEGF in a given tissue is determined by the combination of alternative splicing and proteolytic processing that occurs in the cells of the tissue (Ferrara, N., et al. (2006) Retina 26:859).

Age-related macular degeneration (AMD) remains the leading cause of blindness in people over 55 years of age. The disease is characterized by the formation of insoluble deposits called drusen within the macula, the part of the retina that has the highest density of photoreceptors and is involved in central vision. In the initial stages of AMD, the deposits are avascular and the disease generally progresses slowly. However, in about 10% of the patients, this so-called "dry" form of AMD becomes vascularized and turns into the "wet" form of AMD, during which the disease becomes more progressive and vision deteriorates at a faster rate. In many cases, the progression from blurriness of central vision to virtual blindness occurs in less than two years. In the advanced stage of the disease, the exudative or wet form of AMD, new blood vessels penetrate from the choriocapillaris into the central part of the retina (macula), occluding central vision. In the United States, the prevalence of wet AMD is about 1.8 million and is expected to increase to close to 3 million by 2020. The incidence of wet AMD in the United States is about 210,000 people each year.

Recently, AMD has been treated by blocking VEGF-mediated induction of angiogenesis and blood vessels leakiness by direct injection into the eye of high-affinity antagonists that bind to VEGF, preventing interaction of VEGF with its cell-surface receptors on endothelial cells.

There is considerable evidence that dual inhibition of VEGF and PDGF-B signaling leads to more efficient blocking of angiogenesis coupled with regression of new blood vessels. For example, clinical evidence suggests that dual inhibition of VEGF and PDGF-B can achieve a more complete inhibition of ocular angiogenesis in AMD patients. An aptamer inhibitor of PDGF-B (E10030), originally discovered at NeXstar Pharmaceuticals (Green, L. S., et al. (1996) Biochemistry 35:14413; U.S. Pat. Nos. 6,207,816; 5,731,144; 5,731,424; and 6,124,449), is being developed by Ophthotech Corporation as a treatment for AMD. E10030 (Fovista®) is a DNA-based modified aptamer that binds to PDGF-AB or PDGF-BB with a $K_d$ of approximately 100 pM and inhibits the functions of PDGF-B both in vitro and in vivo.

In a Phase 1 study, anti-PDGF therapy with E10030 tested in combination with Lucentis® anti-VEGF therapy resulted in vision gain of three lines in 59% of treated patients after 12 weeks of therapy. This is a considerably higher percentage of patients with improved visual acuity compared to the 34-40% observed historically with Lucentis alone. In addition, the combination treatment was accompanied with marked neovascular regression in all study participants. Enhanced efficacy with combination treatment was recently corroborated in a phase 2 study of 449 patients with wet AMD. Patients receiving the combination of Fovista (1.5 mg) and Lucentis gained a mean of 10.6 letters of vision at 24 weeks, compared to 6.5 letters for patients receiving Lucentis monotherapy (p=0.019), representing a 62% additional visual acuity benefit.

SUMMARY

The present disclosure provides aptamers that bind to platelet-derived growth factor B (PDGF-B, including PDGF-BB and PDGF-AB), aptamers that bind vascular endothelial growth factor (VEGF, including VEGF-121 and VEGF-165), and aptamer constructs comprising an aptamer that binds PDGF-B and an aptamer that binds VEGF. The disclosed aptamers and aptamer constructs are useful as therapeutics for preventing, treating, and/or ameliorating proliferating diseases or conditions, including but not limited to, atherosclerosis, macular degeneration, fibrosis, diabetic retinopathy, and cancer, and/or other diseases or conditions in which PDGF and/or VEGF is implicated. In various embodiments, the aptamer constructs are capable of binding to each of VEGF and PDGF-B independently and/or VEGF and PDGF-B simultaneously. Included are pharmaceutical compositions or formulations comprising a PDGF aptamer, a VEGF aptamer, or a VEGF/PDGF-B aptamer construct, or a pharmaceutically acceptable salt of any of the foregoing, and at least one pharmaceutically acceptable carrier. Such compositions can be prepared in any suitable pharmaceutically acceptable dosage form.

In one aspect, the disclosure provides for a nucleic acid molecule comprising the nucleic sequence: 5'-C-G-A-C-A-G-C-A-Z-G-Z-A-Z-G-C-A-C-A-Z-C-Z-3' (SEQ ID NO: 830), wherein Z is a C-5 modified pyrimidine, and at least one of positions 4, 9, 10, 11 and 12 of the nucleic acid molecule comprise a phosphorothioate linkage or moiety, wherein position 1 is the first nucleoside starting from the 5'-terminus of the nucleic acid molecule. In a related aspect, the at least two, three, four or five of positions 4, 9, 10, 11 and 12 of the nucleic acid molecule comprise a phosphorothioate linkage or moiety, and wherein position 1 is the first nucleoside starting from the 5'-terminus of the nucleic acid molecule.

In another aspect, the nucleic acid molecule comprises at least one, two, three, four, five, six, seven, eight, nine or ten 2'-O-methyl nucleosides. In a related aspect, at least one of positions 1, 4, 6, 7, 14, 15, 16, 17, 18, 20 and 21 of the nucleic acid molecule comprise a 2'-O-methyl modification, and wherein position 1 is the first nucleoside starting from the 5'-terminus of the nucleic acid molecule. In yet another related aspect, the at least two, three, four, five, six, seven, eight, nine, ten or eleven of positions 1, 4, 6, 7, 14, 15, 16, 17, 18, 20 and 21 of the nucleic acid molecule comprise a 2'-O-methyl modification, and wherein position 1 is the first nucleoside starting from the 5'-terminus of the nucleic acid molecule.

In another aspect, the C-5 modified pyrimidine independently, and for each occurrence, is selected from the group consisting a 5-(N-benzylcarboxyamide)-2'-deoxyuridine (BndU), 5-(N-benzylcarboxyamide)-2'-O-methyluridine, 5-(N-benzylcarboxyamide)-2'-fluorouridine, 5-(N-phenethylcarboxyamide)-2'-deoxyuridine (PedU), 5-(N-thiophenylmethylcarboxyamide)-2'-deoxyuridine (ThdU), 5-(N-isobutylcarboxyamide)-2'-deoxyuridine (iBudU), 5-(N-isobutylcarboxyamide)-2'-O-methyluridine, 5-(N-isobutylcarboxyamide)-2'-fluorouridine, 5-(N-tryptaminocarboxyamide)-2'-deoxyuridine (TrpdU), 5-(N-tryptaminocarboxyamide)-2'-O-methyluridine, 5-(N-tryptaminocarboxyamide)-2'-fluorouridine, 5-(N-[1-(3-trimethylamonium) propyl]carboxyamide)-2'-deoxyuridine chloride, 5-(N-naphthylmethylcarboxyamide)-2'-deoxyuridine (NapdU), 5-(N-naphthylmethylcarboxyamide)-2'-O-methyluridine, 5-(N-naphthylmethylcarboxyamide)-2'-fluorouridine, and 5-(N-[1-(2,3-dihydroxypropyl)] carboxyamide)-2'-deoxyuridine). In a related aspect, the C-5 modified pyrimidine is a 5-(N-naphthylmethylcarboxyamide)-2'-deoxyuridine (NapdU).

In another aspect, the nucleic acid molecule comprises DNA, RNA or a combination thereof.

In another aspect, the nucleic acid molecule binds a PDGF protein with a binding affinity of less than 10 nM, less than 5 nM, less than 2 nM, or less than 1 nM.

In another aspect, the nucleic acid molecule further comprises an inverted deoxynucleotide at the 3' terminus of the nucleic acid molecule. In a related aspect, the deoxynucleotide is a deoxythymidine.

In another aspect, the nucleic acid molecule is less sensitive to a nuclease compared to the same nucleic acid molecule without a phosphorothioate linkage or moiety. In a related aspect, the nuclease is a DNase enzyme. In yet another related aspect, the DNase enzyme is a DNase I or DNase II enzyme.

In another aspect, the nucleic acid molecule is more stable in viterous humor from New Zealand White Rabbits compared to the same nucleic acid molecule without a phosphorothioate linkage or moiety.

In another aspect, the nucleic acid molecule is selected from the group consisting of the 5169 aptamers having the following aptamer ID number 146, 150-159, 172-182 and 188.

In a related aspect, the nucleic acid molecule comprises eleven 2'-O-methyl nucleosides and four or five phosphorothioate linkages or moieties.

In a related aspect, the nucleic acid molecule comprises at least one nucleotide having a phosphorothioate linkage or moiety and a 2'-O-methyl group.

In another aspect, this disclosure provides for a nucleic acid molecule comprising the nucleic sequence: 5'-C-C-G-Z-Z-C-A-A-G-Z-G-C-Z-Z-G-Z-A-G-G-A-Z-Z-Z-A-A-A-Z-G-G-3' (SEQ ID NO: 831), wherein Z is a C-5 modified pyrimidine, and at least one of positions 24, 25 and 26 of the nucleic acid molecule comprise a phosphorothioate linkage or moiety, wherein position 1 is the first nucleoside starting from the 5'-terminus of the nucleic acid molecule. In a related aspect, at least two or three of positions 24, 25 and 26 comprise a phosphorothioate linkage or moiety, and wherein position 1 is the first nucleoside starting from the 5'-terminus of the nucleic acid molecule.

In a related aspect, the nucleic acid molecule comprises at least one, two, three, four, five, six, seven, eight or nine 2'-O-methyl nucleosides.

In another aspect, at least one of positions 1, 6, 9, 12, 15, 17, 18, 22, 28 and 29 of the nucleic acid molecule comprise a 2'-O-methyl modification, and wherein position 1 is the first nucleoside starting from the 5'-terminus of the nucleic acid molecule. In a related aspect, at least two, three, four, five, six, seven, eight or nine of positions 1, 6, 9, 12, 15, 17, 18, 22, 28 and 29 of the nucleic acid molecule comprise a 2'-O-methyl modification, and wherein position 1 is the first nucleoside starting from the 5'-terminus of the nucleic acid molecule.

In another aspect, the C-5 modified pyrimidine independently, and for each occurrence, is selected from the group consisting a 5-(N-benzylcarboxyamide)-2'-deoxyuridine (BndU), 5-(N-benzylcarboxyamide)-2'-O-methyluridine, 5-(N-benzylcarboxyamide)-2'-fluorouridine, 5-(N-phenethylcarboxyamide)-2'-deoxyuridine (PedU), 5-(N-thiophenylmethylcarboxyamide)-2'-deoxyuridine (ThdU), 5-(N-isobutylcarboxyamide)-2'-deoxyuridine (iBudU), 5-(N-isobutylcarboxyamide)-2'-O-methyluridine, 5-(N-isobutylcarboxyamide)-2'-fluorouridine, 5-(N-tryptaminocarboxyamide)-2'-deoxyuridine (TrpdU), 5-(N-tryptaminocarboxyamide)-2'-O-methyluridine, 5-(N-tryptaminocarboxyamide)-2'-fluorouridine, 5-(N-[1-(3-trimethylamonium) propyl]carboxyamide)-2'-deoxyuridine chloride, 5-(N-naphthylmethylcarboxyamide)-2'-deoxyuridine (NapdU), 5-(N-naphthylmethylcarboxyamide)-2'-O-methyluridine, 5-(N-naphthylmethylcarboxyamide)-2'-fluorouridine, and 5-(N-[1-(2,3-dihydroxypropyl)]carboxyamide)-2'-deoxyuridine). In a related aspect, the C-5 modified pyrimidine is a 5-(N-naphthylmethylcarboxyamide)-2'-deoxyuridine (NapdU).

In another aspect, the nucleic acid molecule comprises DNA, RNA or a combination thereof.

In another aspect, the nucleic acid molecule binds a VEGF protein with a binding affinity of less than 10 nM, less than 5 nM, less than 2 nM, or less than 1 nM.

In another aspect, the nucleic acid molecule further comprises an inverted deoxynucleotide at the 3' terminus of the nucleic acid molecule. In a related aspect, the deoxynucleotide is a deoxythymidine.

In another aspect, the nucleic acid molecule is less sensitive to a nuclease compared to the same nucleic acid molecule without a phosphorothioate linkage or moiety. In a related aspect, the nuclease is a DNase enzyme. In yet another related aspect, the DNase enzyme is a DNase I or DNase II enzyme.

In another aspect, the nucleic acid molecule is more stable in viterous humor from New Zealand White Rabbits compared to the same nucleic acid molecule without a phosphorothioate linkage or moiety.

In another aspect, the nucleic acid molecule is selected from the group consisting of the 4867-31 aptamers having the following aptamer ID number 192, 409-417, 419-429, 438-445 and 475-483.

In another aspect, the nucleic acid molecule comprises nine or ten 2'-O-methyl nucleosides and one, two or three phosphorothioate linkages or moieties.

In another aspect, the nucleic acid molecule comprises at least one nucleotide having a phosphorothioate linkage or moiety and a 2'-O-methyl group.

In another aspect, the disclosure provides a nucleic acid molecule comprising the nucleic sequence: 5'-Z-Z"-A-C-H-G-Z-Z-A-C-V-C-G-C-G-Z'-Z-Z-A-Z-A-G-C-G-3' (SEQ ID NO: 832), wherein Z, Z' and Z" are independently, for each occurrence selected from the group consisting of 5-(N-benzylcarboxyamide)-2'-deoxyuridine (BndU), 5-(N-benzylcarboxyamide)-2'-O-methyluridine, 5-(N-benzylcarboxyamide)-2'-fluorouridine, 5-(N-phenethylcarboxyamide)-2'-deoxyuridine (PedU), 5-(N-thiophenylmethylcarboxyamide)-2'-deoxyuridine (ThdU), 5-(N-isobutylcarboxyamide)-2'-deoxyuridine (iBudU), 5-(N-isobutylcarboxyamide)-2'-O-methyluridine, 5-(N-isobutylcarboxyamide)-2'-fluorouridine, 5-(N-tryptaminocarboxyamide)-2'-deoxyuridine (TrpdU), 5-(N-tryptaminocarboxyamide)-2'-O-methyluridine, 5-(N-tryptaminocarboxyamide)-2'-fluorouridine, 5-(N-[1-(3-trimethylamonium) propyl]carboxyamide)-2'-deoxyuridine chloride, 5-(N-naphthylmethylcarboxyamide)-2'-deoxyuridine (NapdU), 5-(N-naphthylmethylcarboxyamide)-2'-O-methyluridine, 5-(N-2-naphthylmethylcarboxyamide)-2'-deoxyuridine (2NapdU), 5-(N-2-naphthylmethylcarboxyamide)-2'-O-methyluridine, 5-(N-naphthylmethylcarboxyamide)-2'-fluorouridine, 5-(N-3,4-methylenedioxybenzylcarboxyamide)-2'-deoxyuridine (MBndU), and 5-(N-[1-(2,3-dihydroxypropyl)]carboxyamide)-2'-deoxyuridine); V is a three carbon linker and H is hexaethylene glycol linker; and at least one of positions 8, 9, 15, 16 and 17 of the nucleic acid molecule comprise a phosphorothioate linkage or moiety, wherein position 1 is the first nucleoside starting from the 5'-terminus of the nucleic acid molecule, and H and V are considered a single position for purposes of counting positions of the nucleic acid molecule. In a related aspect, Z and Z' are independently, for each occurrence, selected from is selected from the group consisting a 5-(N-benzylcarboxyamide)-2'-deoxyuridine (BndU), 5-(N-benzylcarboxyamide)-2'-O-methyluridine, 5-(N-benzylcarboxyamide)-2'-fluorouridine, 5-(N-phenethylcarboxyamide)-2'-deoxyuridine (PedU), 5-(N-thiophenylmethylcarboxyamide)-2'-deoxyuridine (ThdU), 5-(N-isobutylcarboxyamide)-2'-deoxyuridine (iBudU), 5-(N-isobutylcarboxyamide)-2'-O-methyluridine, 5-(N-isobutylcarboxyamide)-2'-fluorouridine, 5-(N-tryptaminocarboxyamide)-2'-deoxyuridine (TrpdU), 5-(N-tryptaminocarboxyamide)-2'-O-methyluridine, 5-(N-tryptaminocarboxyamide)-2'-fluorouridine, 5-(N-[1-(3-trimethylamonium) propyl]carboxyamide)-2'-deoxyuridine chloride, 5-(N-naphthylmethylcarboxyamide)-2'-deoxyuridine (NapdU), 5-(N-naphthylmethylcarboxyamide)-2'-O-methyluridine, 5-(N-naphthylmethylcarboxyamide)-2'-fluorouridine, and 5-(N-[1-(2,3-dihydroxypropyl)] carboxyamide)-2'-deoxyuridine). In another related aspect, Z is independently, for each occurrence, selected from a 5-(N-benzylcarboxyamide)-2'-deoxyuridine (BndU) or methylenedioxybenzyl-dU. In another related aspect, Z' is a 5-(N-naphthylmethylcarboxyamide)-2'-deoxyuridine (NapdU).

In another aspect, at least two or three of positions 8, 9, 15, 16 and 17 comprise a phosphorothioate linkage or moiety, and wherein position 1 is the first nucleoside starting from the 5'-terminus of the nucleic acid molecule, and H and V are considered a single position for purposes of counting positions of the nucleic acid molecule.

In another aspect, the nucleic acid molecule comprises at least one, two, three, four, five, six, seven or eight 2'-O-methyl nucleosides.

In another aspect, at least one of positions 3, 7, 12, 13, 18, 19, 21 and 24 of the nucleic acid molecule comprise a 2'-O-methyl modification, and wherein position 1 is the first nucleoside starting from the 5'-terminus of the nucleic acid molecule, and H and V are considered a single position for purposes of counting positions of the nucleic acid molecule. In a related aspect, at least two, three, four, five, six, seven or eight of positions 3, 7, 12, 13, 18, 19, 21 and 24 of the nucleic acid molecule comprise a 2'-O-methyl modification, and wherein position 1 is the first nucleoside starting from the 5'-terminus of the nucleic acid molecule, and H and V are considered a single position for purposes of counting positions of the nucleic acid molecule.

In another aspect, the Z is a 5-(N-benzylcarboxyamide)-2'-deoxyuridine (BndU).

In another aspect, the nucleic acid molecule comprises DNA, RNA or a combination thereof.

In another aspect, the nucleic acid molecule binds a PDGF protein with a binding affinity of less than 10 nM, less than 5 nM, less than 2 nM, or less than 1 nM. In another aspect, the nucleic acid molecule inhibits PDGF-mediated phosphorylation of a PDGF receptor.

In another aspect, the nucleic acid molecule further comprises an inverted deoxynucleotide at the 3' terminus of the nucleic acid molecule. In a related aspect, the deoxynucleotide is a deoxythymidine.

In another aspect, the nucleic acid molecule is less sensitive to a nuclease compared to the same nucleic acid molecule without a phosphorothioate linkage or moiety. In a related aspect, the nuclease is a DNase enzyme. In yet another related aspect, the DNase enzyme is a DNase I or DNase II enzyme.

In another aspect, the nucleic acid molecule is more stable in viterous humor from New Zealand White Rabbits compared to the same nucleic acid molecule without a phosphorothioate linkage or moiety.

In another aspect, the nucleic acid molecule is selected from the group consisting of the 4149-8 aptamers having the following aptamer ID number 379, 391, 418-426, 431-437 and 453-459.

In another aspect, the nucleic acid molecule comprises seven or eight 2'-O-methyl nucleosides and four, five, six, seven or eight phosphorothioate linkages or moieties.

In another aspect, the nucleic acid molecule comprises at least one nucleotide having a phosphorothioate linkage or moiety and a 2'-O-methyl group.

In another aspect the disclosure provides for a composition comprising two nucleic acid molecules selected from the nucleic acid molecules described herein.

In another aspect, the composition is in the form selected from the group selected from a solution, a powder, a gel and an emulsion.

In another aspect, the two nucleic acid molecules are covalently linked or non-covalently linked.

In another aspect, this disclosure provides for a pharmaceutical composition comprising at least one nucleic acid molecule of any of the nucleic acid molecules described herein, and a pharmaceutically acceptable carrier.

In another aspect, the pharmaceutical composition is for intravitreal injection.

In another aspect, this disclosure provides for a method for treating macular degeneration comprising administering to a subject with macular degeneration a therapeutically effective amount of the pharmaceutical composition as described herein.

In another aspect, this disclosure provides for a method for preventing macular degeneration comprising administering to a subject at risk for developing macular degeneration a therapeutically effective amount of the pharmaceutical composition as described herein.

In another aspect, this disclosure provides for a method for treating an ophthalmic condition comprising administering to a subject with an ophthalmic condition a therapeutically effective amount of the pharmaceutical composition as described herein. In a related aspect, the ophthalmic condition is selected from the group consisting of retinitis, macular degeneration, choroiditis, retinopathy, hypertensive retinopathy, diabetic retinopathy, chronic dry eye, AIDS-related vision loss, amblyopia, hemianopia, retinal vein occlusions, trachoma, keratoconus, chorioretinal inflammation, central serous retinopathy, uveitis, retinal dystrophy, edema, glaucoma, and cataract.

In another aspect, the macular degeneration is age-related macular degeneration. In a related aspect, the macular degeneration is dry age-related macular degeneration or wet age-related macular degeneration.

In another aspect, this disclosure provides for a method for treating fibrosis comprising administering to a subject with fibrosis a therapeutically effective amount of the pharmaceutical composition as described herein. In a related aspect, the fibrosis is selected from pulmonary fibrosis, renal fibrosis, and cystic fibrosis.

In another aspect, this disclosure provides for a method for treating a cardiovascular disease comprising administering to a subject with the cardiovascular disease a therapeutically effective amount of the pharmaceutical composition as described herein. In a related aspect, the cardiovascular disease is selected from atherosclerosis, restenosis, a cardiac hypertrophy related condition, and a vascular disorder.

In another aspect, this disclosure provides for a method for treating cancer comprising administering to a subject with cancer a therapeutically effective amount of the pharmaceutical composition as described herein. In a related aspect, the cancer is selected from bladder cancer, lung cancer, breast cancer, melanoma, colon and rectal cancer, lymphoma, endometrial cancer, pancreatic cancer, liver cancer, renal cancer, prostate cancer, leukemia, and thyroid cancer.

In another aspect, this disclosure provides for a nucleic acid molecule comprising the nucleic sequence: 5'-$C^1$-G-A-$C^{1,2}$-A-$G^1$-$C^1$-A-$Z^2$-$G^2$-$Z^2$-A$^2$-Z-$G^1$-$C^1$-$A^1$-$C^1$-$A^1$-Z-$C^1$-$Z^1$-3' (SEQ ID NO: 833), wherein, $C^1$ is independently, for each occurrence, selected from the group consisting of a cytidine, a deoxycytidine and a 2'-O-methylcytidine; $C^{1,2}$ is independently, for each occurrence, selected from the group consisting of a cytidine, a cytidine comprising a phosphorothioate linkage, a deoxycytidine, a deoxycytidine comprising a phosphorothioate linkage, a 2'-O-methylcytidine and a 2'-O-methylcytidine comprising a phosphorothioate linkage; $G^1$ is independently, for each occurrence, selected from the group consisting of a guanosine, a deoxyguanosine and a 2'-O-methylguanosine; $G^2$ is independently, for each occurrence, selected from the group consisting of a guanosine, a guanosine comprising a phosphorothioate linkage, a deoxyguanosine and a deoxyguanosine comprising a phosphorothioate linkage; Z is independently, for each occurrence, selected from the group consisting of a uridine, a deoxyuridine and a 5-(N-naphthylmethylcarboxyamide)-2'-deoxyuridine (NapdU); $Z^1$ is independently, for each occurrence, selected from the group consisted of a uridine, a deoxyuridine, a 2'-O-methyluridine, a 5-(N-naphthylmethylcarboxyamide)-2'-deoxyuridine (NapdU) and a 5-(N-naphthylmethylcarboxyamide)-2'-deoxyuridine (NapdU) comprising a 2'-O-methyl group; $Z^2$ is independently, for each occurrence, selected from the group consisted of a uridine, a uridine comprising a phosphorothioate linkage, a deoxyuridine, a deoxyuridine comprising a phosphorothioate linkage, a 5-(N-naphthylmethylcarboxyamide)-2'-deoxyuridine (NapdU) and a 5-(N-naphthylmethylcarboxyamide)-2'-deoxyuridine (NapdU) comprising a phosphorothioate linkage; $A^1$ is independently, for each occurrence, selected from the group consisting of an adenosine, a deoxyadenosine and a 2'-O-methyladenosine; $A^2$ is independently, for each occurrence, selected from the group consisting of an adenosine, an adenosine comprising a phosphorothioate linkage, a deoxyadenosine and a deoxyadenosine comprising a phosphorothioate linkage; and wherein, the nucleic acid molecule comprises at least one, two, three, four or five phosphorothioate linkages.

In a related aspect, $C^1$ is a 2'-O-methylcytidine. In a related aspect, $C^{1,2}$ is a 2'-O-methylcytidine comprising a phosphorothioate linkage. In a related aspect, $G^1$ is a 2'-O-methylguanosine. In a related aspect, $G^2$ is a deoxyguanosine comprising a phosphorothioate linkage. In a related aspect, $Z^1$ is a 5-(N-naphthylmethylcarboxyamide)-2'-deoxyuridine (NapdU) comprising a 2'-O-methyl group. In a related aspect, $Z^2$ is a 5-(N-naphthylmethylcarboxyamide)-2'-deoxyuridine (NapdU) comprising a phosphorothioate linkage. In a related aspect, $A^1$ is a 2'-O-methyladenosine. In a related aspect, $A^2$ is a deoxyadenosine comprising a phosphorothioate linkage.

In another aspect, this disclosure provides for a nucleic acid molecule comprising the nucleic sequence: 5'-$C^1$-C-G-Z-Z-$C^1$-A-A-$G^1$-Z-G-$C^1$-Z-Z-$G^1$-Z-$A^1$-$G^1$-G-A-Z-$Z^1$-Z-$A^2$-$A^2$-$A^2$-Z-$G^1$-$G^1$-3' (SEQ ID NO: 834) wherein, $C^1$ is independently, for each occurrence, selected from the group consisting of a cytidine, a deoxycytidine and a 2'-O-methylcytidine; $G^1$ is independently, for each occurrence, selected from the group consisting of a guanosine, a deoxyguanosine and a 2'-O-methylguanosine; $G^1$ is independently, for each occurrence, selected from the group consisting of a guanosine, a deoxyguanosine and a 2'-O-methylguanosine; Z is independently, for each occurrence, selected from the group consisting of a uridine, a deoxyuridine and a 5-(N-naphthylmethylcarboxyamide)-2'-deoxyuridine (NapdU); $Z^1$ is independently, for each occurrence, selected from the group consisting of a uridine, a deoxyuridine, a 2'-O-methyluridine, a 5-(N-naphthylmethylcarboxyamide)-2'-deoxyuridine (NapdU) and a 5-(N-naphthylmethylcarboxyamide)-2'-deoxyuridine (NapdU) comprising a 2'-O-methyl group; $A^1$ is independently, for each occurrence, selected from the group consisting of an adenosine, a deoxyadenosine and a 2'-O-methyladenosine; $A^2$ is independently, for each occurrence, selected from the group consisting of an adenosine, an adenosine comprising a phosphorothioate linkage, a deoxyadenosine and a deoxyadenosine comprising a phosphorothioate linkage; and wherein, the nucleic acid molecule comprises at least one, two, three, four or five phosphorothioate linkages.

In a related aspect, $C^1$ is a 2'-O-methylcytidine. In a related aspect, $G^1$ is a 2'-O-methylguanosine. In a related aspect, Z is a 5-(N-naphthylmethylcarboxyamide)-2'-deoxyuridine (NapdU). In a related aspect, $Z^1$ is a 5-(N-naphthylmethylcarboxyamide)-2'-deoxyuridine (NapdU) comprising a 2'-O-methyl group. In a related aspect, $A^1$ is a 2'-O-methyladenosine. In a related aspect, $A^2$ is a deoxyadenosine comprising a phosphorothioate linkage.

In another aspect, this disclosure provides for a nucleic acid molecule comprising the nucleic sequence: 5'-Z-Z''-$A^1$-C-H-G-$Z^1$-$Z^2$-$A^2$-C-V-$C^1$-$G^1$-C-$G^2$-$Z'^2$-$Z^2$-$Z^1$-$A^1$-Z-A-G-C-$G^1$-3' (SEQ ID NO: 835) wherein, $C^1$ is independently, for each occurrence, selected from the group consisting of a cytidine, a deoxycytidine and a 2'-O-methylcytidine; $G^1$ is independently, for each occurrence, selected from the group consisting of a guanosine, a deoxyguanosine and a 2'-O-methylguanosine; $G^2$ is independently, for each occurrence, selected from the group consisting of a guanosine, a guanosine comprising a phosphorothioate linkage, a deoxyguanosine and a deoxyguanosine comprising a phosphorothioate linkage; Z is independently, for each occurrence, selected from the group consisting of a uridine, a deoxyuridine, a 5-(N-naphthylmethylcarboxyamide)-2'-deoxyuridine (NapdU), a 5-(N-2-naphthylmethylcarboxyamide)-2'-deoxyuridine (2NapdU), a 5-(N-benzylcarboxyamide)-2'-deoxyuridine (BndU) and a 5-(N-3,4-methylenedioxybenzylcarboxyamide)-2'-deoxyuridine (MBndU); Z'' is independently, for each occurrence, selected from the group consisting of a uridine, a deoxyuridine, a 5-(N-benzylcarboxyamide)-2'-deoxyuridine (BndU) and a 5-(N-3,4-methylenedioxybenzylcarboxyamide)-2'-deoxyuridine (MBndU); $Z'^2$ is independently, for each occurrence, selected from the group consisted of a uridine, a uridine comprising a phosphorothioate linkage, a deoxyuridine, a deoxyuridine comprising a phosphorothioate linkage, a 5-(N-benzylcarboxyamide)-2'-deoxyuridine (BndU), a 5-(N-benzylcarboxyamide)-2'-deoxyuridine (BndU) comprising a phosphorothioate linkage, a 5-(N-2-naphthylmethylcarboxyamide)-2'-deoxyuridine (2NapdU), a 5-(N-2-naphthylmethylcarboxyamide)-2'-deoxyuridine (2NapdU) comprising a phosphorothioate linkage, a 5-(N-naphthylmethylcarboxyamide)-2'-deoxyuridine (NapdU) and a 5-(N-naphthylmethylcarboxyamide)-2'-deoxyuridine (NapdU) comprising a phosphorothioate linkage; $Z^1$ is independently, for each occurrence, selected from the group consisting of a uridine, a deoxyuridine, a 2'-O-methyluridine, a 5-(N naphthylmethylcarboxyamide)-2'-deoxyuridine (NapdU), a 5-(N-naphthylmethylcarboxyamide)-2'-deoxyuridine (NapdU) comprising a 2'-O-methyl group, a 5-(N-benzylcarboxyamide)-2'-deoxyuridine (BndU), a 5-(N-benzylcarboxyamide)-2'-deoxyuridine (BndU) comprising a 2'-O-methyl group, a methylenedioxybenzyl-dU and a methylenedioxybenzyl-dU comprising a 2'-O-methyl group; $Z^2$ is independently, for each occurrence, selected from the group consisting of a uridine, a uridine comprising a phosphorothioate linkage, a deoxyuridine, a deoxyuridine comprising a phosphorothioate linkage, a 5-(N-naphthylmethylcarboxyamide)-2'-deoxyuridine (NapdU) and a 5-(N-naphthylmethylcarboxyamide)-2'-deoxyuridine (NapdU) comprising a phosphorothioate linkage, a 5-(N-benzylcarboxyamide)-2'-deoxyuridine (BndU), a 5-(N-benzylcarboxyamide)-2'-deoxyuridine (BndU) comprising a phosphorothioate linkage, a methylenedioxybenzyl-dU and a methylenedioxybenzyl-dU comprising a phosphorothioate linkage; $A^1$ is independently, for each occurrence, selected from the group consisting of an adenosine, a deoxyadenosine and a 2'-O-methyladenosine; $A^2$ is independently, for each occurrence, selected from the group consisting of an adenosine, an adenosine comprising a phosphorothioate linkage, a deoxyadenosine and a deoxyadenosine comprising a phosphorothioate linkage; V is a three carbon linker; H is hexaethylene glycol linker; and wherein, the nucleic acid molecule comprises at least one, two, three, four or five phosphorothioate linkages.

In a related aspect, $C^1$ is a 2'-O-methylcytidine. In a related aspect, $G^1$ is a 2'-O-methylguanosine. In a related aspect, $G^2$ is a deoxyguanosine comprising a phosphorothioate linkage. In a related aspect, Z is a 5-(N-benzylcarboxyamide)-2'-deoxyuridine (BndU). In a related aspect, $Z'^2$ is a 5-(N-naphthylmethylcarboxyamide)-2'-deoxyuridine (NapdU) comprising a phosphorothioate linkage. In a related aspect, In a related aspect, $Z^1$ is a 5-(N-benzylcarboxyamide)-2'-deoxyuridine (BndU) comprising a 2'-O-methyl group. In a related aspect, $Z^2$ is a 5-(N-benzylcarboxyamide)-2'-deoxyuridine (BndU) comprising a phosphorothioate linkage. In a related aspect, $A^1$ is a 2'-O-methyladenosine. In a related aspect, $A^2$ is a deoxyadenosine comprising a phosphorothioate linkage.

In another aspect, this disclosure provides for a composition comprising two nucleic acid molecules selected from the group consisting of any one of the nucleic acid molecules described herein.

In a related aspect, the composition is in the form selected from the group selected from a solution, a powder, a gel and an emulsion.

In a related aspect, the two nucleic acid molecules are covalently linked or non-covalently linked.

In another aspect, the nucleic acid molecule inhibits PDGF-mediated phosphorylation of a PDGF receptor.

In another aspect, this disclosure provides for a pharmaceutical composition comprising at least one nucleic acid molecule described herein and a pharmaceutically acceptable carrier.

In a related aspect, the pharmaceutical composition is for intravitreal injection.

In another aspect, this disclosure provides for a method for treating macular degeneration comprising administering to a subject with macular degeneration a therapeutically effective amount of the pharmaceutical composition comprising at least one nucleic acid molecule described herein and a pharmaceutically acceptable carrier.

In another aspect, this disclosure provides for a method for preventing macular degeneration comprising administering to a subject at risk for developing macular degeneration a therapeutically effective amount of the pharmaceutical composition comprising at least one nucleic acid molecule described herein and a pharmaceutically acceptable carrier.

In another aspect, this disclosure provides for a method for treating an ophthalmic condition comprising administering to a subject with an ophthalmic condition a therapeutically effective amount of the pharmaceutical composition comprising at least one nucleic acid molecule described herein and a pharmaceutically acceptable carrier.

In a related aspect, the ophthalmic condition is selected from the group consisting of retinitis, macular degeneration, choroiditis, retinopathy, hypertensive retinopathy, diabetic retinopathy, chronic dry eye, AIDS-related vision loss, amblyopia, hemianopia, retinal vein occlusions, trachoma, keratoconus, chorioretinal inflammation, central serous retinopathy, uveitis, retinal dystrophy, edema, glaucoma, and cataract.

In a related aspect, the macular degeneration is age-related macular degeneration.

In a related aspect, the macular degeneration is dry age-related macular degeneration or wet age-related macular degeneration.

In another aspect, this disclosure provides for a method for treating fibrosis comprising administering to a subject with fibrosis a therapeutically effective amount of the pharmaceutical composition comprising at least one nucleic acid molecule described herein and a pharmaceutically acceptable carrier.

In a related aspect, the fibrosis is selected from pulmonary fibrosis, renal fibrosis, and cystic fibrosis.

In another aspect, this disclosure provides for a method for treating a cardiovascular disease comprising administering to a subject with the cardiovascular disease a therapeutically effective amount of the pharmaceutical composition comprising at least one nucleic acid molecule described herein and a pharmaceutically acceptable carrier.

In a related aspect, the cardiovascular disease is selected from atherosclerosis, restenosis, a cardiac hypertrophy related condition, and a vascular disorder.

In another aspect, this disclosure provides for a method for treating cancer comprising administering to a subject with cancer a therapeutically effective amount of the pharmaceutical composition comprising at least one nucleic acid molecule described herein and a pharmaceutically acceptable carrier.

In a related aspect, the cancer is selected from bladder cancer, lung cancer, breast cancer, melanoma, colon and rectal cancer, lymphoma, endometrial cancer, pancreatic cancer, liver cancer, renal cancer, prostate cancer, leukemia, and thyroid cancer.

In a related aspect, anyone of the nucleic acid molecule described herein is an aptamer.

In another aspect, the present disclosure provides methods for preventing, treating, and/or ameliorating a disease or condition mediated by PDGF and/or VEGF. In some embodiments, a method comprises administering a PDGF aptamer, a VEGF aptamer, and/or a VEGF/PDGF-B aptamer construct, or pharmaceutical compositions comprising any of these, to a subject, such as a mammal. In some embodiments, the subject is a human. Specifically, methods for treating, preventing, and/or ameliorating fibrosis, atherosclerosis, macular degeneration, diabetic retinopathy, and/or cancer are provided. In some embodiments, a disease or condition mediated by PDGF and/or VEGF is one in which PDGF and/or VEGF activity may directly or indirectly contribute to the disease or condition. Such diseases or conditions include, but are not limited to, fibrosis, atherosclerosis, macular degeneration, diabetic retinopathy, and cancer. In some embodiments, the disease or condition to be treated, prevented, and/or ameliorated is age-related macular degeneration (AMD), diabetic retinopathy, or other ocular diseases, such as glaucoma, chronic dry eye, AIDS-related vision loss, amblyopia, hemianopia, retinal vein occlusions, trachoma, keratoconus, chorioretinal inflammation, central serous retinopathy, uveitis, retinitis, hypertensive retinopathy, retinal dystrophy, etc. In some embodiments, the disease or condition to be treated, prevented, and/or ameliorated is renal fibrosis or renal cancer.

In some embodiments, aptamers and aptamer constructs disclosed herein have potential applications ranging from biomarker discovery and diagnostics (Ostroff, R. M., et al.

(2010) PLoS One 5:e15003; Mehan, M., et al. (2012) PLoS One 7:e35157) to histochemistry and imaging (Gupta, S., et al. (2011) Appl. Immunohistochem. Mol. Morphol. 19:273).

In some embodiments, a therapeutic effect (e.g., treating, preventing, and/or ameliorating fibrosis, atherosclerosis, macular degeneration, or cancer, etc.) may be achieved by administering a PDGF aptamer, a VEGF aptamer, and/or a PDGF/VEGF aptamer construct such that the aptamer or aptamer construct is exposed to, and can bind to, PDGF and/or VEGF. In some embodiments, such binding occurs regardless of the method of delivery of the aptamer to the subject being treated. In some embodiments, the therapeutic effect may be achieved by administering the PDGF aptamer, VEGF aptamer, or PDGF/VEGF aptamer construct such that it is exposed to, and binds to, PDGF and/or VEGF and prevents or reduces the binding of PDGF and/or VEGF to one or more cell receptors.

In some embodiments, the binding of a PDGF aptamer to PDGF-BB or PDGF-AB interferes with the binding of PDGF-BB or PDGF-AB to the PDGF-α receptor. In some embodiments, the binding of a PDGF aptamer to PDGF-BB or PDGF-AB interferes with the binding of PDGF-BB or PDGF-AB to the PDGF-β receptor. In some embodiments, a PDGF aptamer to PDGF-BB or PDGF-AB reduces phosphorylation of a PDGF receptor (such as PDGF-α receptor and/or PDGF-β receptor).

In some embodiments, the binding of a VEGF aptamer to VEGF-121, VEGF-110, VEGF-165, VEGF-189, or another alternatively spliced or functionally-active proteolytic fragment of VEGF interferes with the binding of the growth factor to VEGFR-1 (Flt-1). In some embodiments, the binding of a VEGF aptamer to VEGF-121, VEGF-110, VEGF-165, VEGF-189, or another alternatively spliced or functionally-active proteolytic fragment of VEGF, interferes with the binding of the growth factor to VEGFR-2 (KDR). In some embodiments, a VEGF aptamer reduces phosphorylation of a VEGF receptor (such as VEGF-1 receptor and/or VEGF-1 receptor).

In some embodiments, a PDGF/VEGF aptamer construct reduces the level of phosphorylation of a PDGF receptor (such as PDGF-α receptor and/or PDGF-3 receptor) and reduces the level of phosphorylation of a VEGF receptor (such as VEGFR-1 and/or VEGFR-2). In some embodiments, a PDGF aptamer, a VEGF aptamer, or a PDGF/VEGF aptamer construct reduces signaling along the signal transduction pathway of a PDGF receptor and/or a VEGF receptor.

In some embodiments, a PDGF aptamer, a VEGF aptamer, or a PDGF/VEGF aptamer construct is administered with one or more additional active agents. Such administration may be sequential or in combination.

In some embodiments, an in vitro diagnostic method comprises contacting a PDGF aptamer with a sample suspected of comprising PDGF. In some embodiments, an in vivo diagnostic method comprises administering a suitably labeled PDGF aptamer to an individual suspected of having a PDGF-mediated disease or disorder, wherein the labeled PDGF aptamer is detected for the purpose of diagnosing or evaluating the health status of the individual. The label used may be selected in accordance with the imaging modality to be used.

In some embodiments, an in vitro diagnostic method comprises contacting a VEGF aptamer with a sample suspected of comprising VEGF. In some embodiments, an in vivo diagnostic method comprises administering a suitably labeled VEGF aptamer to an individual suspected of having VEGF-mediated disease or disorder, wherein the labeled VEGF aptamer is detected for the purpose of diagnosing or evaluating the health status of the individual. The label used may be selected in accordance with the imaging modality to be used.

In some embodiments, an in vitro diagnostic method comprises contacting a PDGF/VEGF aptamer construct with a sample suspected of comprising PDGF and/or VEGF. In another aspect, the present disclosure provides an in vivo diagnostic method comprising obtaining a suitably labeled PDGF/VEGF aptamer construct, injecting the labeled PDGF/VEGF aptamer construct into an individual suspected of having a PDGF/VEGF-mediated disease or disorder, and detecting the labeled PDGF/VEGF aptamer construct for the purpose of diagnosing or evaluating the health status of the individual. The label used may be selected in accordance with the imaging modality to be used.

In some embodiments, the present invention provides aptamer constructs comprising a PDGF aptamer and a VEGF aptamer.

In some embodiments, the present disclosure provides an aptamer that efficiently binds to a protein predominantly through hydrophobic interactions.

In some embodiments, the present disclosure provides an aptamer-protein complex, wherein the aptamer binds to the protein substantially through hydrophobic interactions.

In some embodiments, the present disclosure provides an aptamer capable of forming a co-crystal complex with a protein target, wherein the complex comprises fewer than 7 hydrogen bonds.

In some embodiments, the present disclosure provides an aptamer capable of forming a co-crystal complex with a protein target, wherein the complex comprises a pseudoknot domain involving 16 nucleotides or less.

In some embodiments, the present disclosure provides an aptamer capable of binding to a protein target, wherein the aptamer binds to the protein target with less than or equal to 1 polar contact per 100 $Å^2$ of interface area, wherein the polar contact comprises one or more hydrogen bonds and one or more charge-charge interactions, and wherein the interface area is a fraction of the protein surface area occupied by the aptamer.

In another aspect, this disclosure provides for a nucleic acid molecule comprising the nucleic sequence: 5'-C-C-G-Z-Z-C$^1$-A-A-G$^1$-Z-G-C$^1$-Z-Z-G$^1$-Z-A$^1$-G$^1$-G-A-Z-Z$^1$-Z-A$^2$-A$^2$-A$^2$-Z-G$^1$-G$^1$-3' (SEQ ID NO: 836) wherein, C$^1$ is independently, for each occurrence, selected from the group consisting of a cytidine, a deoxycytidine and a 2'-O-methylcytidine; G$^1$ is independently, for each occurrence, selected from the group consisting of a guanosine, a deoxyguanosine and a 2'-O-methylguanosine; Z is independently, for each occurrence, selected from the group consisted of a uridine, a deoxyuridine and a 5-(N-naphthylmethylcarboxyamide)-2'-deoxyuridine (NapdU); Z$^1$ is independently, for each occurrence, selected from the group consisted of a uridine, a deoxyuridine, a 2'-O-methyluridine, a 5-(N-naphthylmethylcarboxyamide)-2'-deoxyuridine (NapdU) and a 5-(N-naphthylmethylcarboxyamide)-2'-deoxyuridine (NapdU) comprising a 2'-O-methyl group; A$^1$ is independently, for each occurrence, selected from the group consisting of an adenosine, a deoxyadenosine and a 2'-O-methyladenosine; A$^2$ is independently, for each occurrence, selected from the group consisting of an adenosine, an adenosine comprising a phosphorothioate linkage, a deoxyadenosine and a deoxyadenosine comprising a phosphorothioate linkage; and wherein, the nucleic acid molecule comprises at least one, two, three, four or five phosphorothioate linkages.

In a related aspect, $C^1$ is a 2'-O-methylcytidine. In a related aspect, $G^1$ is a 2'-O-methylguanosine. In a related aspect, Z is a 5-(N-naphthylmethylcarboxyamide)-2'-deoxyuridine (NapdU). In a related aspect, $Z^1$ is a 5-(N-naphthylmethylcarboxyamide)-2'-deoxyuridine (NapdU) comprising a 2'-O-methyl group. In a related aspect, $A^1$ is a 2'-O-methyladenosine. In a related aspect, $A^2$ is a deoxyadenosine comprising a phosphorothioate linkage.

BRIEF DESCRIPTION OF THE DRAWINGS

FIGS. 1C and 1D show the $K_d$ ratios for modified aptamers versus the parent aptamer, and aptamer 4149-8_130, in which a particular Bn-dU nucleobase has been replaced by another modified dU nucleobase, relative to the parent aptamer (a value of 1 indicates the modified aptamer inhibits phosphorylation of PDGFRβ equally as well as the parent, while a value >1 indicates the modified aptamer has less potent inhibitory activity compared to the parent).

FIG. 2A shows a table of aptamer 4149-8_260 intramolecular contacts and aptamer-PDGF contacts.

FIG. 5A shows binding affinity of various aptamers for different PDGF dimeric isoforms, in the presence and absence of 200 nM tRNA; and FIG. 5B shows an alignment of the amino acid sequences for the mature forms of PDGF-A, -B, -C and -D; as described in Example 3. Amino acid residues for PDGF-A that are shown in bold are involved in propeptide binding, and amino acid residues for PDGF-B that are shown in bold are involved in PDGFRβ binding (Shim et al, (2010) Proc. Natl. Acad. Sci. USA 107(25): 11307). Box shading indicates residues involved in aptamer 4149-8_260 binding to PDGF-B chain 1 (dark shading), and PDGF-B chain 2 (light shading).

FIG. 6A shows the $K_d$ ratio for modified aptamers made by substituting each indicated position in aptamer 4149-8_38 (SED ID NO: 38) with a three-carbon C-3 linker, and $K_d$ values for PDGF-BB binding, PDGF-AB binding, as well as cellular $IC_{50}$ for five modified aptamers based on parent aptamer 4149-8.

FIG. 7B shows a schematic representation and structural representation of the aptamer conformation when bound to a PDGF-B subunit; as described in Example 2. Non-canonical base pairs are coded based on the nomenclature of Leontis and Westhof (Leontis N. B. et al. (2003) Curr. Opin. Struct. Biol. 13(3):300). Dark gray=PDGF-B Chain 1; Light gray=PDGF-B Chain 2; Bn=Bn-dU, Pe=Pe-dU, Th=Th-dU.

FIG. 8A illustrates the aptamer structure, showing domains, basepairing and stacking interactions. The stems of the miniknot deviate significantly from B-form DNA due to substantial buckling and propeller angles as well as helical underwinding. Bn20 is the hinge that interfaces with the 5' stem through stacking with U8. FIG. 8B illustrates Stem 1 (S1) end view. FIG. 8C illustrates S1 and L2 side views. The modified nucleotides form a hydrophobic cluster with Bn2, Bn7 and Bn8 from the 5' stem interacting with Bn16, Pe17, Th18 and Bn20 from the miniknot. Bn8 makes edge-to-face π-π interactions with Bn16 and Bn20. The non-canonical dU-dU base pair utilizes H-bonding to the amide linker of Bn20. FIG. 8D illustrates the details of the non-canonical base pair between Pe-dU17 and Bn-dU20. FIG. 8E illustrates aromatic interactions stabilizing the base of miniknot S1. FIG. 8F illustrates a base triple which is formed between the C10-G15 Watson-Crick pair in the S1 and L2 nucleotide, A21. The Leontis-Westhof classification of this base triple is cis Watson-Crick/Watson-Crick, trans Sugar edge/Hoogsteen (Leontis N. B. et al. (2003) Curr. Opin. Struct. Biol. 13:300). The base triple is not planar as there is a 34° propeller twist angle between A21 and G15 as well as considerable buckling and propeller twisting between the Watson-Crick base pair (Table 5). FIG. 8G illustrates residue mA11, the single extruded base in L1 and the backbone turn. FIG. 8H illustrates an axial view of 52. FIG. 8I illustrates an axial view of the 5' stem motif which highlights the significant deviation from B-form DNA. The global C1'-C1' helical parameters indicate the dU-dU pair is overtwisted (400) resulting in a ~124° bend in the backbone which flattens to near linear (~172°) between Bn-dU1 and Bn-dU2. The significant radial displacement between Bn-dU7-Bn-dU8 and near zero displacement between Bn-dU2-dA3 results in greater stacking overlap between bases 2-4 and 6-7. FIG. 8J which illustrates the non-canonical base pair between Bn-dU2 and Bn-dU8. FIG. 8K illustrates the interdomain junction formed by modified nucleotides. FIG. 8L illustrates Bn8 making edge-to-face π-π interactions with Bn16 and Bn20 that define the topology of the interdomain junction. The deleterious impact of substituting Bn-dU at position 8 of aptamer 4149-8_260 (SEQ ID NO: 211) with an iB-dU (SEQ ID NO: 255) is evident in the space-filling images shown in FIG. 8M and FIG. 8N. Bn8 (FIG. 8M) is capable of making energetically favorable π-π interactions with neighboring aromatic groups and allows the SOMAmer to pack more tightly. In contrast, iB8 (FIG. 8N) is not aromatic and thus lacks the ability for π-stacking interactions with neighboring aromatic groups. Additionally, the iB group is not as large and leaves a hole in the middle of the hydrophobic cluster.

In FIG. 9A, Bn-dU1 occupies a pocket under a salt bridge at the homodimer interface. The U1 base makes hydrogen bonds to the protein backbone at Val39 while the benzyl ring is sandwiched between the aliphatic side chain of Arg 56 and the disulfide bond of Cys43-Cys52. In FIG. 9B, Bn2 has an edgewise interaction with Trp40 and is nestled between the methylene side chains of Asn55 and Leu38. FIG. 9C illustrates that the aromatic ring of Bn7 tucks up against the aliphatic portions of Asn54 and Asn55 side chains. FIG. 9D illustrates that the Leu38 and Ile75 side chains present a hydrophobic surface for the benzyl ring of Bn-dU8 to contact the protein. FIG. 9E illustrates that Bn16 has edge-to-face π-stacking with Trp40 and van der Waals contact with the aliphatic region of Arg73. FIG. 9F illustrates that Pe17 is surrounded by the hydrophobic side chains of Leu38, Trp40, Arg73 and Ile75. Arg73 makes a hydrogen bond to the amide linker of Pe-dU17 and a charge-charge interaction with the aptamer backbone. FIG. 9G illustrates Th18 encircled by the hydrophobic side chains of Arg73, Ile75 and Phe84. FIG. 9H illustrates that stacking interactions between the protein and the aptamer are present between Pro82 and Bn20 and U8, and Phe84 makes edge-to-face contact with U20. Bn20 makes additional hydrophobic contact to Ile77 and Lys80.

FIG. 10A shows the six co-crystal structures of traditional aptamers (PDB IDs: vWF, 3HXO; Thrombin, 3QLP; GlnRs tRNA, 1EXD; Human IgG, 3AGV; MS2 coat protein, 6MSF; NF-kB, 1OOA) that were analyzed for the number of polar contacts (hydrogen bonds plus charge-charge interactions), and the contact surface area. The results are plotted versus the reported binding affinities for these six aptamer-target complexes (dark gray bars) and for three SOMAmers (light gray bars) including the PDGF-SL5 (4149-8_260) complex and two unpublished SOMAmer-target structures. The relationship between the number of polar contacts and the contact surface area for the six traditional aptamers was analyzed by linear regression, and the 99% confidence interval is indicated by the gray shading on the floor of the figure. FIG. 10B illustrates shape complementarity of the PDGF-SOMAmer complex as exhibited by Pe-dU17 and Th-dU18. Left, PDGF chain 1 is shown as a dark gray surface, Pe-dU17 and Th-dU18 are shown as space-filling representations. Right, same view as left panel, except Pe-dU17 is shown as stick representation. FIG. 10C illustrates detail of Bn-dU1 interaction with PDGF, with PDGF chain 1 shown as a dark gray surface, PDGF chain 2 shown as a light gray surface, and Bn-dU1 shown as a space-filling representation.

FIG. 11A receptor co-crystal showing PDGF homodimer (chain 1, medium gray; chain 2, light gray) and receptor extracellular domain colored dark gray (from Shim, A. H., et al. (2010) Proc. Natl. Acad. Sci. USA 107(25):11307). FIG. 11B complex of PDGF homodimer (chain 1, medium gray; chain 2, light gray) and SL5 (dark gray). FIG. 11C shows the amino acid sequence of the PDGF-B mature form. Box shading indicates contact residues to 4149-8_260, PDGFRβ or both. PDGF residues that make a 4 Å contact with 4149-8_260, but do not contact PDGFRβ are boxed with no shading. PDGF residues that make 4 Å contact with PDGFRβ, but do not contact 4149-8_260 are boxed with dark gray shading. PDGF residues that make 4 Å contact with both 4149-8_260 and PDGFRβ are boxed with medium gray shading.

FIG. 14 shows the consensus sequence for a set of PDGF-binding clones from the SELEX pool as determined by 454 pyrosequencing and nucleotide frequency at each position, as described in Example 5.

FIG. 16 shows the consensus sequence for a set of VEGF-binding clones from the SELEX pool as determined by 454 pyrosequencing and nucleotide frequency at each position, as described in Example 7.

FIG. 22C shows a table showing various thermodynamic properties and contact characteristics of six previous aptamer-protein crystal structures and three SOMAmer-protein crystal structures, including PDGF-BB: 4149-8_260, as described in Example 2. Interaction features for aptamers and SOMAmers bound to protein targets (FIG. 22C references: (a) Convery et al. (1998) Nat. Struct. Biol. 5(2):133; (b) Nomura et al. (2010) Nucleic Acids Res. 38(21): 7822; (c) Pagano et al. (2008) Biophys. J. 94(2):562; (d) Huang et al. (2003) Proc. Natl. Acad. Sci. USA 100(16): 9268; (e) Huang et al. (2009) Structure 17(11):1476; (f) Bullock et al. (2000) Nat. Struct. Biol. 7(6):497. Free energy calculations were determined from the measured binding affinities for SOMAmers, or the published $K_d$ values using the following temperatures: MS2, thrombin, NFkB, vWF, and GlnRs, room temperature (296 K); IgG, 298 K; SOMAmers, 310 K. SOMAmers show a trend toward higher binding affinities; average free energy of binding, or $-\Delta G$ value, is 11.4±1.3 kcal/mol for the six aptamers and 14.3 kcal/mol±0.8 kcal/mol for the three SOMAmers. Protein contact atoms within 4 Å of each ligand were determined in PyMOL. Interface area calculations were made with PISA (aptamers) (Krissinel et al. (2007) J. Mol. Biol. 372(3):774) or PyMOL (SOMAmers) (DeLano (2002) The Pymol Molecular Graphics System, Delano Scientific, San Carlos, Calif.). Within this relatively small data set of crystallographically evaluated interactions, aptamers engage their targets with an average ligand efficiency of 0.21±0.14 kcal/mol per nonhydrogen contact atom, compared to 0.16±0.04 kcal/mol per non-hydrogen contact atom for SOMAmers. Free energies of binding per interface area are also similar, with an average value of 0.017±0.009 kcal·mol$^{-1}$·Å$^{-2}$ for aptamers and 0.012±0.001 kcal·mol$^{-1}$·Å$^{-2}$ for SOMAmers. The value of free energy of binding per polar contact, calculated from values in the table, is about twice as large for SOMAmers (average of 1.75±0.36 kcal/mol per polar contact) as for aptamers (0.89±0.56 kcal/mol per polar contact).

DETAILED DESCRIPTION

Figure 1A:
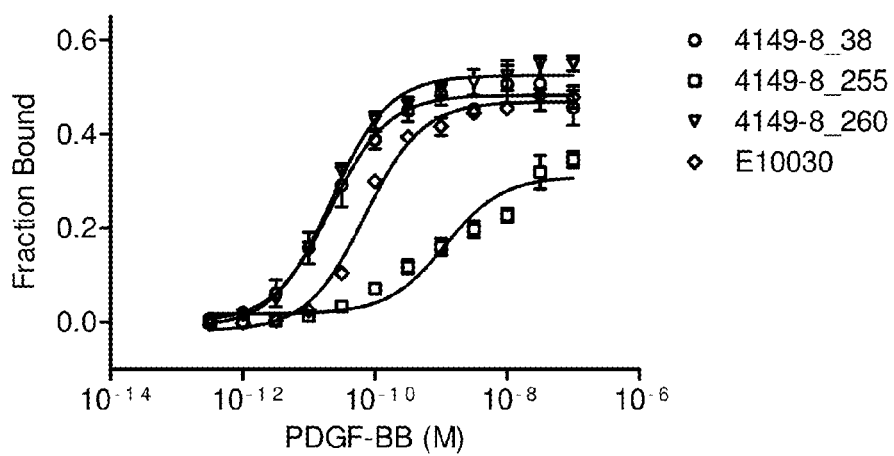
FIG. 1A shows determination of $K_d$ values for three slow off rate modified aptamers and aptamer E10030.

Reference will now be made in detail to representative embodiments of the invention. While the invention will be described in conjunction with the enumerated embodiments, it will be understood that the invention is not intended to be limited to those embodiments. On the contrary, the invention is intended to cover all alternatives, modifications, and equivalents that may be included within the scope of the present invention as defined by the claims.

One skilled in the art will recognize many methods and materials similar or equivalent to those described herein, which could be used in and are within the scope of the practice of the present invention. The present invention is in no way limited to the methods and materials described.

Unless defined otherwise, technical and scientific terms used herein have the same meaning as commonly understood by one of ordinary skill in the art(s) to which this invention belongs. Although any methods, devices, and materials similar or equivalent to those described herein can be used in the practice or testing of the invention, the preferred methods, devices and materials are now described.

All publications, published patent documents, and patent applications cited in this disclosure are indicative of the level of skill in the art(s) to which the disclosure pertains. All publications, published patent documents, and patent applications cited herein are hereby incorporated by reference to the same extent as though each individual publication, published patent document, or patent application was specifically and individually indicated as being incorporated by reference.

As used in this disclosure, including the appended claims, the singular forms "a," "an," and "the" include plural references, unless the content clearly dictates otherwise, and are used interchangeably with "at least one" and "one or more." Thus, reference to "an aptamer" includes mixtures of aptamers, and the like.

As used herein, the term "about" represents an insignificant modification or variation of the numerical value such that the basic function of the item to which the numerical value relates is unchanged.

As used herein, the terms "comprises," "comprising," "includes," "including," "contains," "containing," and any variations thereof, are intended to cover a non-exclusive inclusion, such that a process, method, product-by-process, or composition of matter that comprises, includes, or contains an element or list of elements does not include only those elements but may include other elements not expressly listed or inherent to such process, method, product-by-process, or composition of matter.

As used herein, the term "nucleotide" refers to a ribonucleotide or a deoxyribonucleotide, or a modified form thereof, as well as an analog thereof. Nucleotides include species that include purines (e.g., adenine, hypoxanthine, guanine, and their derivatives and analogs) as well as pyrimidines (e.g., cytosine, uracil, thymine, and their derivatives and analogs).

As used herein, "nucleic acid," "oligonucleotide," and "polynucleotide" are used interchangeably to refer to a polymer of nucleotides and include DNA, RNA, DNA/RNA hybrids and modifications of these kinds of nucleic acids, oligonucleotides and polynucleotides, wherein the attachment of various entities or moieties to the nucleotide units at any position are included. The terms "polynucleotide," "oligonucleotide," and "nucleic acid" include double- or single-stranded molecules as well as triple-helical molecules. Nucleic acid, oligonucleotide, and polynucleotide are broader terms than the term aptamer and, thus, the terms nucleic acid, oligonucleotide, and polynucleotide include polymers of nucleotides that are aptamers but the terms nucleic acid, oligonucleotide, and polynucleotide are not limited to aptamers.

As used herein, the terms "modify", "modified", "modification", and any variations thereof, when used in reference to an oligonucleotide, means that at least one of the four constituent nucleotide bases (i.e., A, G, T/U, and C) of the oligonucleotide is an analog or ester of a naturally occurring nucleotide. In some embodiments, the modified nucleotide confers nuclease resistance to the oligonucleotide. In some embodiments, the modified nucleotides lead to predominantly hydrophobic interactions of aptamers with protein targets resulting in high binding efficiency and stable co-crystal complexes. A pyrimidine with a substitution at the C-5 position is an example of a modified nucleotide. Modifications can include backbone modifications, methylations, unusual base-pairing combinations such as the isobases isocytidine and isoguanidine, and the like. Modifications can also include 3' and 5' modifications, such as capping. Other modifications can include substitution of one or more of the naturally occurring nucleotides with an analog, internucleotide modifications such as, for example, those with uncharged linkages (e.g., methyl phosphonates, phosphotriesters, phosphoamidates, carbamates, etc.) and those with charged linkages (e.g., phosphorothioates, phosphorodithioates, etc.), those with intercalators (e.g., acridine, psoralen, etc.), those containing chelators (e.g., metals, radioactive metals, boron, oxidative metals, etc.), those containing alkylators, and those with modified linkages (e.g., alpha anomeric nucleic acids, etc.). Further, any of the hydroxyl groups ordinarily present on the sugar of a nucleotide may be replaced by a phosphonate group or a phosphate group; protected by standard protecting groups; or activated to prepare additional linkages to additional nucleotides or to a solid support. The 5' and 3' terminal OH groups can be phosphorylated or substituted with amines, organic capping group moieties of from about 1 to about 20 carbon atoms, polyethylene glycol (PEG) polymers in some embodiments ranging from about 10 to about 80 kDa, PEG polymers in some embodiments ranging from about 20 to about 60 kDa, or other hydrophilic or hydrophobic biological or synthetic polymers. In some embodiments, modifications are of the C-5 position of pyrimidines. These modifications can be produced through an amide linkage directly at the C-5 position or by other types of linkages.

Polynucleotides can also contain analogous forms of ribose or deoxyribose sugars that are generally known in the art, including 2'-O-methyl-, 2'-O-allyl, 2'-fluoro- or 2'-azido-ribose, carbocyclic sugar analogs, α-anomeric sugars, epimeric sugars such as arabinose, xyloses or lyxoses, pyranose sugars, furanose sugars, sedoheptuloses, acyclic analogs and abasic nucleoside analogs such as methyl riboside. As noted above, one or more phosphodiester linkages may be replaced by alternative linking groups. These alternative linking groups include embodiments wherein phosphate is replaced by P(O)S ("thioate"), P(S)S ("dithioate"), (O)NR$_2$ ("amidate"), P(O)R, P(O)OR', CO or CH$_2$ ("formacetal"), in which each R or R' is independently H or substituted or unsubstituted alkyl (1-20 C) optionally containing an ether (—O—) linkage, aryl, alkenyl, cycloalkyl, cycloalkenyl or aralkyl. Not all linkages in a polynucleotide need be identical. Substitution of analogous forms of sugars, purines, and pyrimidines can be advantageous in designing a final product, as can alternative backbone structures like a polyamide backbone, for example.

As used herein, the term "nuclease" refers to an enzyme capable of cleaving the phosphodiester bond between nucleotide subunits of an oligonucleotide. As used herein, the term "endonuclease" refers to an enzyme that cleaves phosphodiester bond(s) at a site internal to the oligonucleotide. As used herein, the term "exonuclease" refers to an enzyme which cleaves phosphodiester bond(s) linking the end nucleotides of an oligonucleotide. Biological fluids typically contain a mixture of both endonucleases and exonucleases.

As used herein, the terms "nuclease resistant" and "nuclease resistance" refers to the reduced ability of an oligonucleotide to serve as a substrate for an endo- or exonuclease, such that, when contacted with such an enzyme, the oligonucleotide is either not degraded or is degraded more slowly than an oligonucleotide composed of unmodified nucleotides.

Figure 12:
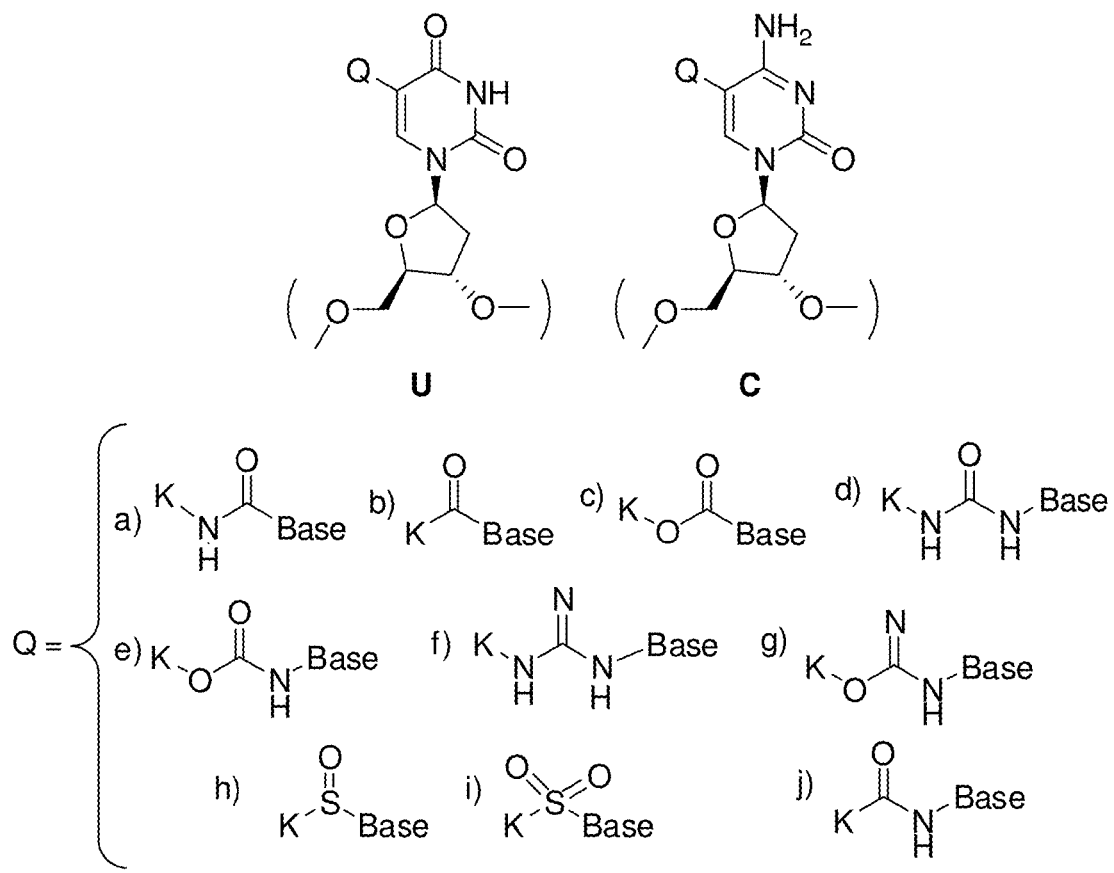
FIG. 12 illustrates certain exemplary C-5 pyrimidine modifications that may be incorporated into aptamers, such as slow off-rate aptamers.
Figure 12:
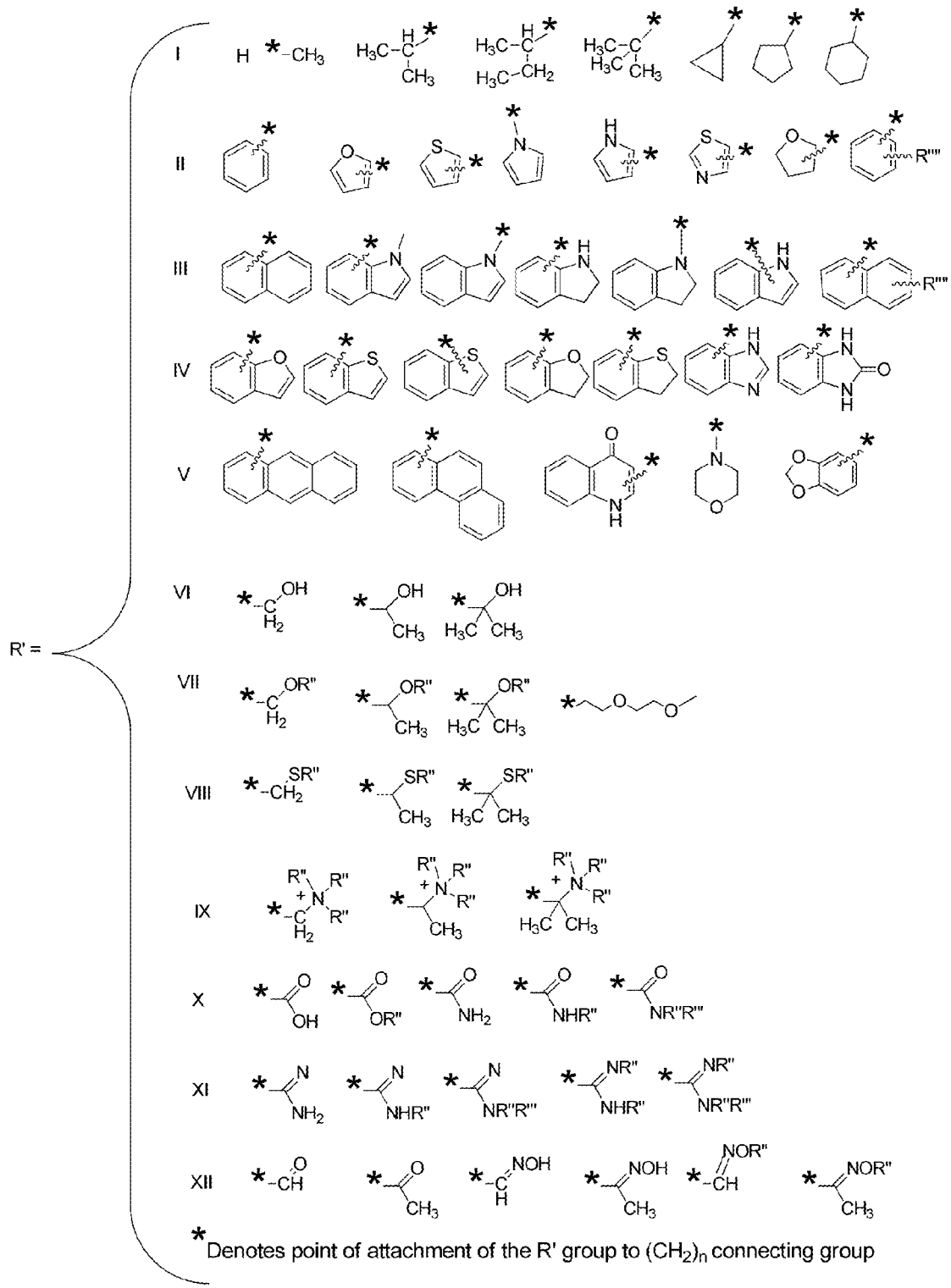

As used herein, the term "C-5 modified pyrimidine" refers to a pyrimidine with a modification at the C-5 position including, but not limited to, those moieties illustrated in FIG. 12. Examples of a C-5 modified pyrimidine include those described in U.S. Pat. Nos. 5,719,273 and 5,945,527. Examples of a C-5 modification include substitution of deoxyuridine at the C-5 position with a substituent independently selected from: benzylcarboxyamide (alternatively benzylaminocarbonyl) (Bn), naphthylmethylcarboxyamide (alternatively naphthylmethylaminocarbonyl) (Nap), tryptaminocarboxyamide (alternatively tryptaminocarbonyl) (Trp), phenethylcarboxyamide (alternatively phenethylamino carbonyl) (Pe), thiophenylmethylcarboxyamide (alternatively thiophenylmethylaminocarbonyl) (Th) and isobutylcarboxyamide (alternatively isobutylaminocarbonyl) (iBu) as illustrated immediately below.

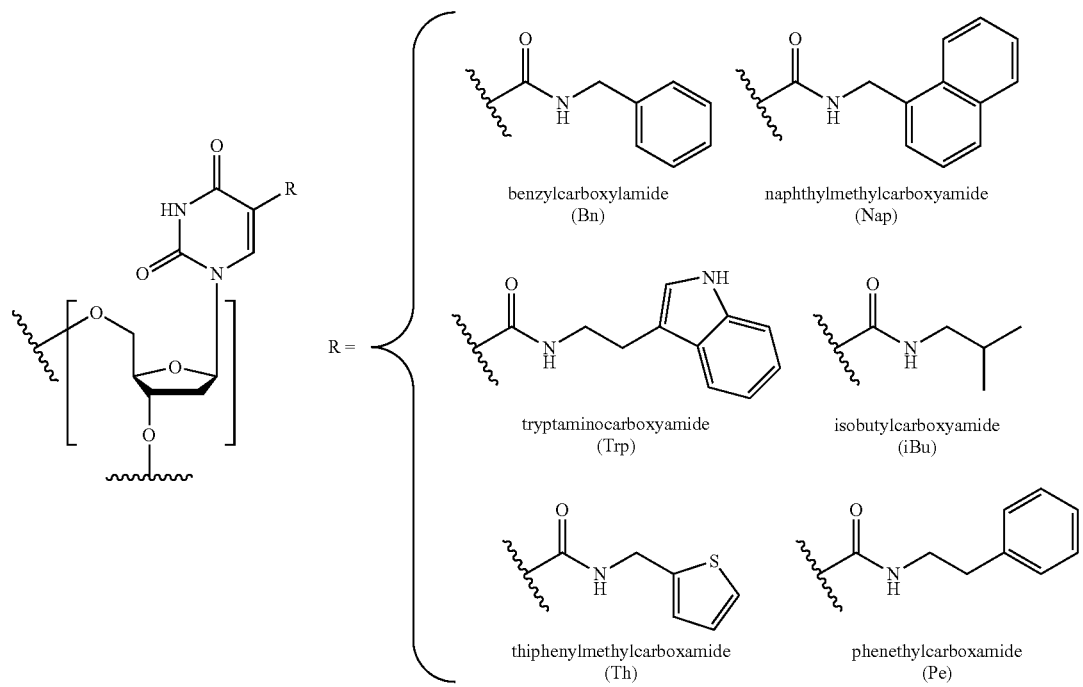

Chemical modifications of a C-5 modified pyrimidine can also be combined with, singly or in any combination, 2'-position sugar modifications, modifications at exocyclic amines, and substitution of 4-thiouridine and the like.

Representative C-5 modified pyrimidines include: 5-(N-benzylcarboxyamide)-2'-deoxyuridine (BndU), 5-(N-benzylcarboxyamide)-2'-O-methyluridine, 5-(N-benzylcarboxyamide)-2'-fluorouridine, 5-(N-isobutylcarboxyamide)-2'-deoxyuridine (iBudU), 5-(N-isobutylcarboxyamide)-2'-O-methyluridine, 5-(N-phenethylcarboxyamide)-2'-deoxyuridine (PedU), 5-(N-thiophenylmethylcarboxyamide)-2'-deoxyuridine (ThdU), 5-(N-isobutylcarboxyamide)-2'-fluorouridine, 5-(N-tryptaminocarboxyamide)-2'-deoxyuridine (TrpdU), 5-(N-tryptaminocarboxyamide)-2'-O-methyluridine, 5-(N-tryptaminocarboxyamide)-2'-fluorouridine, 5-(N-[1-(3-trimethylamonium) propyl]carboxyamide)-2'-deoxyuridine chloride, 5-(N-naphthylmethylcarboxyamide)-2'-deoxyuridine (NapdU), 5-(N-naphthylmethylcarboxyamide)-2'-O-methyluridine, 5-(N-naphthylmethylcarboxyamide)-2'-fluorouridine or 5-(N-[1-(2,3-dihydroxypropyl)]carboxyamide)-2'-deoxyuridine).

Nucleotides can be modified either before or after synthesis of an oligonucleotide. A sequence of nucleotides in an oligonucleotide may be interrupted by one or more non-nucleotide components. A modified oligonucleotide may be further modified after polymerization, such as, for example, by conjugation with any suitable labeling component.

As used herein, the term "at least one pyrimidine," when referring to modifications of a nucleic acid, refers to one, several, or all pyrimidines in the nucleic acid, indicating that any or all occurrences of any or all of C, T, or U in a nucleic acid may be modified or not.

As used herein, A, C, G, U and T denote dA, dC, dG, dU and dT respectively, unless otherwise specified.

As used herein, "nucleic acid ligand," "aptamer," and "clone" are used interchangeably to refer to a non-naturally occurring nucleic acid that has a desirable action on a target molecule. A desirable action includes, but is not limited to, binding of the target, catalytically changing the target, reacting with the target in a way that modifies or alters the target or the functional activity of the target, covalently attaching to the target (as in a suicide inhibitor), and facilitating the reaction between the target and another molecule. In some embodiments, the action is specific binding affinity for a target molecule, such target molecule being a three dimensional chemical structure other than a polynucleotide that binds to the nucleic acid ligand through a mechanism which is independent of Watson/Crick base pairing or triple helix formation, wherein the aptamer is not a nucleic acid having the known physiological function of being bound by the target molecule. Aptamers to a given target include nucleic acids that are identified from a candidate mixture of nucleic acids, where the aptamer is a ligand of the target, by a method comprising: (a) contacting the candidate mixture with the target, wherein nucleic acids having an increased affinity to the target relative to other nucleic acids in the candidate mixture can be partitioned from the remainder of the candidate mixture; (b) partitioning the increased affinity nucleic acids from the remainder of the candidate mixture; and (c) amplifying the increased affinity nucleic acids to yield a ligand-enriched mixture of nucleic acids, whereby aptamers of the target molecule are identified. It is recognized that affinity interactions are a matter of degree; however, in this context, the "specific binding affinity" of an aptamer for its target means that the aptamer binds to its target generally with a much higher degree of affinity than it binds to other, non-target, components in a mixture or sample. An "aptamer" or "nucleic acid ligand" is a set of copies of one type or species of nucleic acid molecule that has a particular nucleotide sequence. An aptamer can include any suitable number of nucleotides. "Aptamers" refer to more than one such set of molecules. Different aptamers can have either the same or different numbers of nucleotides. Aptamers may be DNA or RNA and may be single stranded, double stranded, or contain double stranded or triple stranded regions.

As used herein, a "SOMAmer" or Slow Off-Rate Modified Aptamer refers to an aptamer (including an aptamers comprising at least one nucleotide with a hydrophobic modification) with an off-rate ($t_{1/2}$) of ≥30 minutes, ≥60 minutes, ≥90 minutes, ≥120 minutes, ≥150 minutes, ≥180 minutes, ≥210 minutes, or ≥240 minutes. In some embodiments, SOMAmers are generated using the improved SELEX methods described in U.S. Pat. No. 7,947,447, entitled "Method for Generating Aptamers with Improved Off-Rates".

As used herein, "protein" is used synonymously with "peptide," "polypeptide," or "peptide fragment." A "purified" polypeptide, protein, peptide, or peptide fragment is substantially free of cellular material or other contaminating proteins from the cell, tissue, or cell-free source from which the amino acid sequence is obtained, or substantially free from chemical precursors or other chemicals when chemically synthesized.

As used herein, "co-crystal structure" or "co-crystal complex" is a crystal structure comprising two or more interacting molecules.

As used herein, "cardiovascular condition or disease" means a condition or disease related to heart and its vascular system. Some examples of such conditions or diseases are aneurysm, angina, arrhythmia, atherosclerosis, atrial fibrillation, congestive heart failure, cardiomyopathy, coronary heart disease, restenosis, ischemia, left ventricular hypertrophy, peripheral vascular disease, myocardial infarction, hypertension, valvular heart disease and restrictive heart disease.

As used herein, "fibrosis" means a disease or condition caused by the formation of an excessive and abnormal amount of fibrous connective tissue in an organ resulting in thickening and scarring of connective tissue, leading to malfunction of the organ. Examples of such diseases and conditions are pulmonary fibrosis, renal fibrosis, liver fibrosis and cystic fibrosis.

As used herein, "AMD" or "age related macular degeneration" or "macular degeneration" means a condition of the eye that is caused by damage to the retina and results in a loss of vision in the center of the visual field, called the macula. AMD occurs in "wet" and "dry" forms. In "wet" AMD, blood vessels grow from the choroid behind the retina. In "dry" AMD, cellular debris (drusen) accumulates between the retina and choroid. In either form, the retina can become detached.

As used herein, "ophthalmic disease" or "ophthalmic condition" or "ocular disease" or "ocular condition" refers to any disease or condition that affects or involves occular neovascularization disorders, such as macular degeneration ("wet" and "dry"), retinopathy of prematurity, diabetic retinopathy, neovascular glaucoma, corneal neovascularization, proliferative diabetic retinopathy (the most severe stage of diabetic retinopathy), uveitis (an inflammatory condition of the eye that often leads to macular edema), cystoid macular edema following cataract surgery, myopic degeneration (a condition in which a patient with a high degree of nearsightedness develops choroidal neovascularization), inflammatory macular degeneration (a condition in which a patient with inflammation in the macular area due to infections or other causes, develops choroidal neovascularization), and iris neovascularization (a serious complication of diabetic retinopathy or retinal vein occlusion involving new blood vessel growth on the surface of the iris).

As used herein, "renal disease" or "renal condition" refers to any disease or condition that affects or involves proliferative kidney disorders such as glomerulonephritis, masangial proliferative renal diseases, polycystic kidney disease, kidney cancers, acute kidney failure, nephropathy, amyloidosis, edema, fibrosis, glomerular diseases, renal infarction and nephritis.

As used herein "cancer" means a disease or condition involving unregulated and abnormal cell growth. Some examples of common cancers are bladder cancer, lung cancer, breast cancer, melanoma, colon and rectal cancer, lymphoma, endometrial cancer, pancreatic cancer, liver cancer, renal cancer, prostate cancer, leukemia and thyroid cancer.

As used herein, "modulate" means to alter, either by increasing or decreasing, the level of a peptide or polypeptide, or to alter, either by increasing or decreasing, the stability or activity of a peptide or a polypeptide. The term "inhibit" means to decrease the level of a peptide or a polypeptide or to decrease the stability or activity of a peptide or a polypeptide.

In one embodiment, the protein which is modulated or inhibited is PDGF.

As used herein, the term "bioactivity" indicates an effect on one or more cellular or extracellular process (e.g., via binding, signaling, etc.) which can impact physiological or pathophysiological processes.

As used herein, the terms "platelet-derived growth factor" and "PDGF" refer to PDGF A, B, C, and D isoforms and their homo or heterodimers AA, BB, AB, CC and DD. In some instances, context will determine which isoform and/or heterodimer of PDGF is meant. For example, in some embodiments, the PDGF aptamers described herein bind to the PDGF-B isoform and homo- and heterodimers comprising that isoform, although the aptamers may be described as binding to PDGF. Specifically included in the definition are naturally-occurring human PDGF AA, AB, and BB isoforms and variants. As used herein, PDGF includes all mammalian species of PDGF, including human, canine, feline, murine, primate, equine, and bovine. A nonlimiting exemplary human PDGF-B isoform precursor has the sequence shown in Swiss-Prot Accession No. P01127.1. Nonlimiting exemplary human PDGF-B isoform mature proteins may have the sequence of amino acids 82 to 241 or 82 to 190 of Swiss-Prot Accession No. P01127.1 (referred to herein as amino acids 1 to 160 or 1 to 109 of PDGF-B).

As used herein, "PDGF receptor" refers to a receptor that is bound by and activated by PDGF, such as PDGF receptor α and PDGF receptor β. PDGF receptors include the receptors of any mammalian species, including, but not limited to, human, canine, feline, murine, equine, primate, and bovine. A nonlimiting exemplary human PDGFRβ precursor has the sequence shown in Swiss-Prot Accession No. P09619.1. A nonlimiting exemplary human PDGFRβ mature protein has the sequence of amino acids 33 to 1106 of Swiss-Prot Accession No. P09619.1. A nonlimiting exemplary human PDGFRα precursor has the sequence shown in Swiss-Prot Accession No. P16234.1. A nonlimiting exemplary human PDGFRα mature protein has the sequence of amino acids 24 to 1089 of Swiss-Prot Accession No. P16234.1.

A "PDGF aptamer" is an aptamer that is capable of binding to and modifying the activity of PDGF. In some embodiments, a PDGF aptamer inhibits the activity of PDGF in vitro. In some embodiments, a PDGF aptamer inhibits the activity of PDGF in vivo. A nonlimiting exemplary activity of PDGF is PDGF-mediated phosphorylation of the PDGF receptor, such as PDGF receptor α (PDGF Rα) or PDGF receptor β (PDGF Rβ).

In some embodiments, the "VEGF aptamer" as defined herein is a monomer, dimer or a multimer construct, optionally connected by a linker.

As used herein, the terms "vascular endothelial growth factor", and "VEGF" refer to naturally-occurring VEGF, including isoforms and variants, such as VEGF-121, VEGF-145, VEGF-165, VEGF-183, VEGF-189, and VEGF-206. As used herein, VEGF includes all mammalian species of VEGF, including human, canine, feline, murine, primate, equine, and bovine. A nonlimiting exemplary human VEGF precursor has the sequence shown in Swiss-Prot Accession No. P15692.2. VEGF-121 is described, e.g., in Tee et al. (2001) Biochem. J. 359:219; Bornes et al. (2004) J. Biol. Chem. 279:18717.

As used herein, "VEGF receptor" refers to a receptor that is bound by and activated by VEGF, such as VEGFR-1 and VEGFR-2. VEGF receptors include the receptors of any mammalian species, including, but not limited to, human, canine, feline, murine, equine, primate, and bovine. A nonlimiting exemplary human VEGFR-1 precursor has the sequence shown in Swiss-Prot Accession No. P17948.2. A nonlimiting exemplary human VEGFR-1 mature protein has the sequence of amino acids 27 to 1338 of Swiss-Prot Accession No. P17948.2. A nonlimiting exemplary human VEGFR-2 precursor has the sequence shown in Swiss-Prot Accession No. P35968.2. A nonlimiting exemplary human VEGFR-2 mature protein has the sequence of amino acids 20 to 1356 of Swiss-Prot Accession No. P35968.2.

A "VEGF aptamer" is an aptamer that is capable of binding to and modifying the activity of VEGF. In some embodiments, a VEGF aptamer inhibits the activity of VEGF in vitro. In some embodiments, a VEGF aptamer inhibits the activity of VEGF in vivo. Nonlimiting exemplary activities of VEGF include VEGF-mediated phosphorylation of the VEGF receptor, such as VEGFR-1 or VEGFR-2. In some embodiments, a VEGF aptamer is provided that competes for binding to VEGF-121 with aptamer 4867-31_183.

In some embodiments, the "VEGF aptamer" as defined herein is a monomer, dimer or a multimer construct, optionally connected by a linker.

The terms "PDGF/VEGF aptamer construct" and "VEGF/PDGF aptamer construct" are used interchangeably to refer to a construct comprising a PDGF aptamer and a VEGF aptamer. The order of the words "PDGF" and "VEGF" in "PDGF/VEGF aptamer construct" and "VEGF/PDGF aptamer construct" is not indicative of how the aptamers are linked, e.g., the order does not indicate which aptamer is located at the 5'-most position of an aptamer construct and which aptamer is located at the 3'-most position in the aptamer construct. In some embodiments, a PDGF/VEGF aptamer construct is capable of binding PDGF and VEGF simultaneously. In some embodiments, a PDGF/VEGF aptamer construct is capable of binding each of PDGF and VEGF separately. In a PDGF/VEGF aptamer construct, the PDGF aptamer and the VEGF aptamer may be linked covalently or non-covalently, e.g., through a binding pair such as streptavidin and biotin. A PDGF/VEGF aptamer construct may comprise a linker between the PDGF aptamer and the VEGF aptamer.

As used herein, "disease or condition mediated by PDGF" refers to diseases or conditions in which PDGF activity may directly or indirectly lead to the disease or condition. Nonlimiting exemplary diseases or conditions mediated by PDGF include cardiovascular diseases such as atherosclerosis, restenosis, cardiac hypertrophy related conditions, and vascular disorders; ophthalmic diseases such as macular degeneration; fibrosis; and cancers.

As used herein, "disease or condition mediated by VEGF" refers to diseases or conditions in which VEGF activity may directly or indirectly lead to the disease or condition. Nonlimiting exemplary diseases or conditions mediated by VEGF include cardiovascular diseases, autoimmune diseases, inflammatory rheumatic diseases, ophthalmic diseases, and cancers at various stages in the disease process. Nonlimiting examples of cardiovascular diseases are atherosclerosis, restenosis, cardiac hypertrophy related conditions, and vascular disorders. Non-limiting examples of ophthalmic diseases are retinitis, macular degeneration, choroiditis, retinopathy, edema, glaucoma, and cataract.

As used herein, the term "pharmaceutically acceptable" means approved by a regulatory agency of a federal or a state government or listed in the U.S. Pharmacopoeia or other generally recognized pharmacopoeia for use in animals and, more particularly, in humans. The term "carrier" refers to a diluent, adjuvant, excipient, or vehicle with which the therapeutic is administered and includes, but is not limited to, such sterile liquids as water and oils.

As used herein, the term "pharmaceutically acceptable salt" or "salt" of a PDGF aptamer, VEGF aptamer or a PDGF/VEGF aptamer construct is a product of the disclosed compound that contains an ionic bond and is typically produced by reacting the disclosed compound with either an acid or a base, suitable for administering to an individual. A pharmaceutically acceptable salt can include, but is not limited to, acid addition salts including hydrochlorides, hydrobromides, phosphates, sulphates, hydrogen sulphates, alkylsulphonates, arylsulphonates, arylalkylsulfonates, acetates, benzoates, citrates, maleates, fumarates, succinates, lactates, and tartrates; alkali metal cations such as Li, Na, K, alkali earth metal salts such as Mg or Ca, or organic amine salts.

As used herein, the term "pharmaceutical composition" is a formulation comprising a PDGF aptamer, a VEGF aptamer, or a PDGF/VEGF aptamer construct in a form suitable for administration to an individual. A pharmaceutical composition is typically formulated to be compatible with its intended route of administration. Examples of routes of administration include, but are not limited to, oral and parenteral, e.g., intravenous, intradermal, subcutaneous, inhalation, topical, transdermal, transmucosal, and rectal administration.

As used herein, the term "therapeutically effective amount" generally means the amount necessary to ameliorate at least one symptom of a disorder or condition to be prevented, reduced, or treated as described herein. The phrase "therapeutically effective amount" as it relates to the PDGF aptamers, VEGF aptamers, or PDGF/VEGF aptamer constructs of the present disclosure means the aptamer dosage that provides the specific pharmacological response for which the aptamer is administered in a significant number of individuals in need of such treatment. It is emphasized that a therapeutically effective amount of an aptamer that is administered to a particular individual in a particular instance will not always be effective in treating the conditions/diseases described herein, even though such dosage is deemed to be a therapeutically effective amount by those of skill in the art.

The terms "SELEX" and "SELEX process" are used interchangeably herein to refer generally to a combination of (1) the selection of nucleic acids that interact with a target molecule in a desirable manner, for example by binding with high affinity to a protein, with (2) the amplification of those selected nucleic acids. The SELEX process can be used to identify aptamers with high affinity to a specific target molecule.

SELEX generally includes preparing a candidate mixture of nucleic acids, binding of the candidate mixture to the desired target molecule to form an affinity complex, separating the affinity complexes from the unbound candidate nucleic acids, separating and isolating the nucleic acid from the affinity complex, purifying the nucleic acid, and identifying a specific aptamer sequence. The process may include multiple rounds to further refine the affinity of the selected aptamer. The process can include amplification steps at one or more points in the process. See, e.g., U.S. Pat. No. 5,475,096, entitled "Nucleic Acid Ligands." The SELEX process can be used to generate an aptamer that covalently binds its target as well as an aptamer that non-covalently binds its target. See, e.g., U.S. Pat. No. 5,705,337 entitled "Systematic Evolution of Nucleic Acid Ligands by Exponential Enrichment: Chemi-SELEX."

The SELEX process can be used to identify high-affinity aptamers containing modified nucleotides that confer improved characteristics on the aptamer, such as, for example, improved in vivo stability or improved delivery characteristics. Examples of such modifications include chemical substitutions at the ribose and/or phosphate and/or base positions. SELEX process-identified aptamers containing modified nucleotides are described in U.S. Pat. No. 5,660,985, entitled "High Affinity Nucleic Acid Ligands Containing Modified Nucleotides," which describes oligonucleotides containing nucleotide derivatives chemically modified at the C5 and/or 2'-positions of pyrimidines. U.S. Pat. No. 5,580,737, see supra, describes highly specific aptamers containing one or more nucleotides modified with 2'-amino (2'-NH$_2$), 2'-fluoro (2'-F), and/or 2'-O-methyl (2'-OMe). See also, U.S. Patent Publication No. 20090098549, entitled "SELEX and PHOTOSELEX," which describes nucleic acid libraries having expanded physical and chemical properties and their use in SELEX and photoSELEX.

SELEX can also be used to identify aptamers that have desirable off-rate characteristics. See U.S. Pat. No. 7,947,447, entitled "Method for Generating Aptamers with Improved Off-Rates," which describes improved SELEX methods for generating aptamers that can bind to target molecules. Methods for producing aptamers and photoaptamers having slower rates of dissociation from their respective target molecules are described. The methods involve contacting the candidate mixture with the target molecule, allowing the formation of nucleic acid-target complexes to occur, and performing a slow off-rate enrichment process wherein nucleic acid-target complexes with fast dissociation rates dissociate and do not reform, while complexes with slow dissociation rates remain intact. Additionally, the methods include the use of modified nucleotides in the production of candidate nucleic acid mixtures to generate aptamers with improved off-rate performance (see U.S. Patent Publication No. 2009/0098549, entitled "SELEX and PhotoSELEX"). (See also U.S. Pat. No. 7,855,054 and U.S. Patent Publication No. 2007/0166740). Each of these applications is incorporated herein by reference in its entirety.

In some embodiments, methods of selecting aptamers that bind to a target molecule are provided, comprising: (a) preparing a candidate mixture of nucleic acids, wherein the candidate mixture comprises modified nucleic acids in which at least one pyrimidine in at least one, or in each, nucleic acid of the candidate mixture is chemically modified at the C5-position; (b) contacting the candidate mixture with a target molecule, wherein nucleic acids having an increased affinity to the target molecule relative to other nucleic acids in the candidate mixture bind the target molecule, forming nucleic acid-target molecule complexes; (c) partitioning the increased affinity nucleic acids from the remainder of the candidate mixture; and (d) amplifying the increased affinity nucleic acids to yield a mixture of nucleic acids enriched in nucleic acid sequences that are capable of binding to the target molecule with increased affinity, whereby an aptamer to the target molecule is identified. In certain embodiments, the method further includes performing a slow off-rate enrichment process.

"Target" or "target molecule" or "target" refers herein to any compound upon which a nucleic acid can act in a desirable manner. A target molecule can be a protein, peptide, nucleic acid, carbohydrate, lipid, polysaccharide, glycoprotein, hormone, receptor, antigen, antibody, virus, pathogen, toxic substance, substrate, metabolite, transition state analog, cofactor, inhibitor, drug, dye, nutrient, growth factor, cell, tissue, any portion or fragment of any of the foregoing, etc., without limitation. Virtually any chemical or biological effector may be a suitable target. Molecules of any size can serve as targets. A target can also be modified in certain ways to enhance the likelihood or strength of an interaction between the target and the nucleic acid. A target can also include any minor variation of a particular compound or molecule, such as, in the case of a protein, for example, minor variations in amino acid sequence, disulfide bond formation, glycosylation, lipidation, acetylation, phosphorylation, or any other manipulation or modification, such as conjugation with a labeling component, which does not substantially alter the identity of the molecule. A "target molecule" or "target" is a set of copies of one type or species of molecule or multimolecular structure that is capable of binding to an aptamer. "Target molecules" or "targets" refer to more than one such set of molecules. Embodiments of the SELEX process in which the target is a peptide are described in U.S. Pat. No. 6,376,190, entitled "Modified SELEX Processes Without Purified Protein."

Exemplary PDGF Aptamers

The PDGF aptamers of the instant disclosure were identified using the improved SELEX method for identifying aptamers having slow off-rates as described in Example 1, which describes a representative method for the selection and production of an aptamer that binds PDGF with a slow dissociation rate. A random DNA library composed of benzyl-dU (Bn-dU), dA, dC and dG was used for the selection. Using this method, the DNA aptamer to PDGF-BB designated as aptamer 4149-8_1 (SEQ ID NO: 1) was identified.

Using aptamer 4149-8_1 (SEQ ID NO: 1), studies were conducted to identify the minimum sequence length required to maintain strong affinity for PDGF. Systematic truncation from the 5' and 3' ends led to identification of a core motif consisting of 29 nucleotides (4149-8_38; SEQ ID NO. 38). Aptamer 4149-8_38 exhibited high affinity binding to PDGF-BB ($K_d$ value of 20 pM; FIG. 6).

Figure 3A:
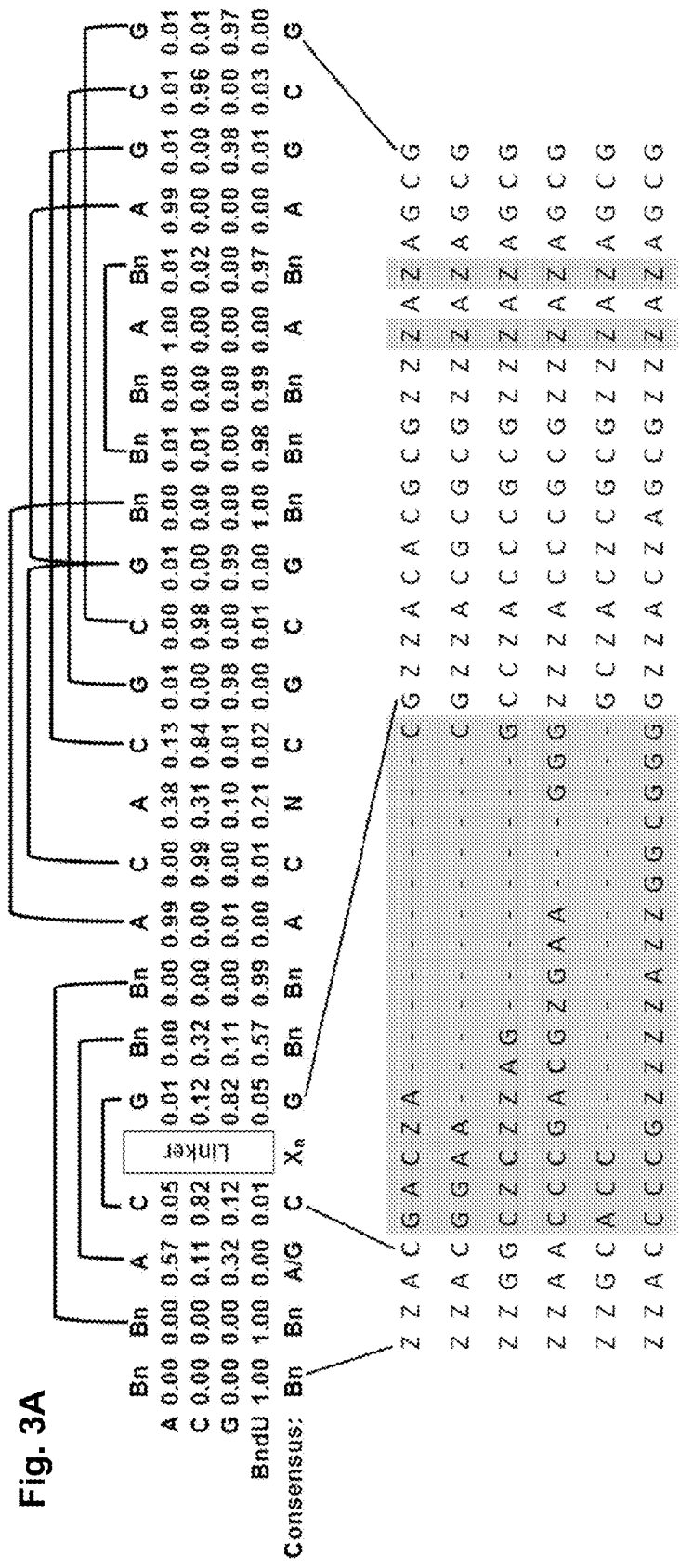
FIG. 3A shows the consensus sequence for a set of clones from the SELEX pool as determined by 454 pyrosequencing and nucleotide frequency at each position, and the sequences for six of the clones.
Figure 3B:
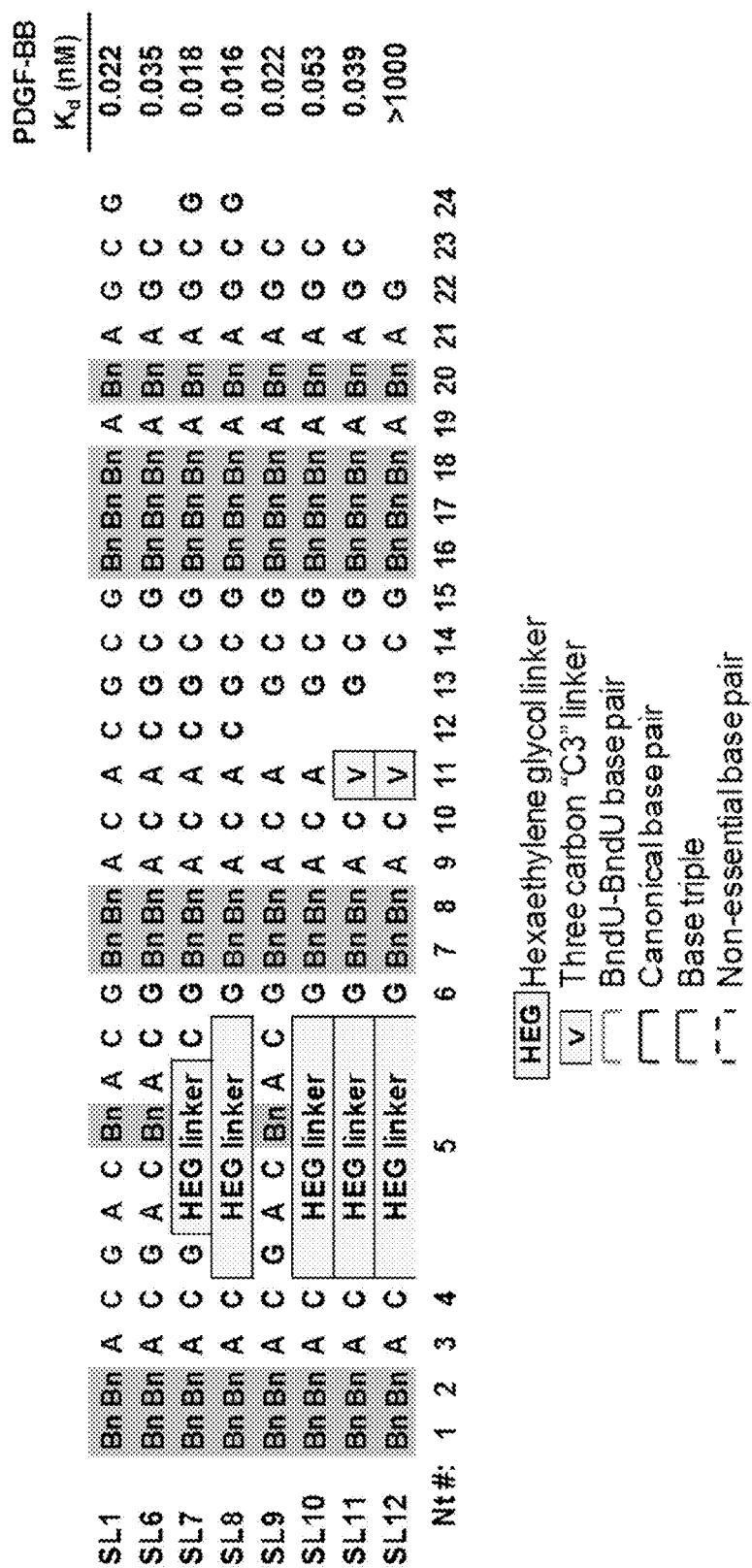
FIG. 3B shows $K_d$ values for modified aptamers based on parent aptamer 4149-8, which were modified as shown, as described in Example 1.

Additional sequencing studies were conducted on the sequence pool from which aptamer 4149-8_1 (SEQ ID NO: 1) was selected. 454 sequencing, which is a large-scale, high throughput method that uses parallel pyrosequencing, provides unbiased sample preparation and very accurate sequence analysis. The sequencing data was used to identify a consensus sequence for a PDGF aptamer as shown in FIG. 3. Furthermore, nucleotide substitution studies illustrated in FIG. 6 led to the discovery that six of eight BndU positions in the consensus sequence were desirable for PDGF binding, but four BndU positions could be replaced with dT with little or no loss of binding activity. A consensus sequence is shown in FIG. 3A, along with a graphic representation of the nucleotide frequency at each position relative to the aptamer 4149-8_1 (SEQ ID NO: 1).

In some embodiments, a PDGF aptamer comprises the sequence:
5'-NZVSL$_n$S'V'ZACNN$_m$GCGZZAZAGCG-3' (SEQ ID NO: 500),
wherein
V is selected from an A, C or G;
V' is selected from a C, G or Z, wherein V' is complementary to V;
S and S' are independently selected from a C or G, wherein S and S' are complementary to each other;
each N is independently selected from any naturally occurring or modified nucleotide;
each Z is independently selected from a modified pyrimidine;
L is selected from any naturally occurring or modified nucleotide, a hydrocarbon linker, a polyethylene glycol linker or a combination thereof;
n is 0 to 20; and m is 0 to 20; and wherein one or more nucleotide insertions are optionally included.

In some embodiments, a PDGF aptamer comprises the sequence:
5'-ZZVSL$_n$S'V'ZACNN$_m$GCGZZZAZAGCG-3' (SEQ ID NO: 501), wherein V, V', N, S, S', Z, L, n, and m are as defined above.

In some embodiments, a PDGF aptamer comprises the sequence:
5'-ZZVCL$_n$GV'ZACNMGCGZZZAZAGCG-3' (SEQ ID NO: 502),
wherein Z, V, V', N, Z, L, and n are as defined above and M is selected from C and A.

In some embodiments, a PDGF aptamer comprises the sequence: 5'-ZZACL$_n$GZZACACGCGZZZAZAGCG-3' (SEQ ID NO: 503), wherein Z, L, and n are as defined above.

In some embodiments, a PDGF aptamer comprises the sequence: 5'-ZZACGACZACGZZACACGCGZZ-ZAZAGCG-3' (SEQ ID NO: 504), wherein Z is as defined above.

In some embodiments, a PDGF aptamer comprises the sequence: 5'-ZVSL$_n$S'V'ZACNN$_m$GCGZZZAZAG-3' (SEQ ID NO: 507), wherein
V is selected from an A, C or G;
V' is selected from a C, G or Z, wherein V' is complementary to V;
S and S' are independently selected from a C or G, wherein S and S' are complementary to other;
each N is independently selected from modified or unmodified nucleotide;
each Z is independently selected from a modified pyrimidine;
L is selected from a substituted or unsubstituted $C_2$-$C_{20}$ linker and a modified or unmodified nucleotide;
n is 1 to 50; and m is 0 to 50; and
wherein one or more nucleotide insertions are optionally included.

In some embodiments, a PDGF aptamer comprises the sequence: 5'-Z'ZVSL$_n$S'V'ZACNN$_m$GCGZZZAZAGC-3' (SEQ ID NO: 508), wherein Z' is a modified pyrimidine or dT; and V, V', N, S, S', Z, L, n, and m are as defined above.

In some embodiments, a PDGF aptamer comprises the sequence: 5'-Z'ZVCL$_n$V'ZACNMGCGZZZAZAGC-3' (SEQ ID NO: 509),
wherein Z, Z', V, V', N, Z, L, and n are as defined above and M is selected from C and A.

In some embodiments, a PDGF aptamer comprises the sequence: 5'-Z'ZACL$_n$GZZACACGCGZZZAZAGC-3' (SEQ ID NO: 510), wherein Z, Z', L, and n are as defined above.

In some embodiments, a PDGF aptamer comprises the sequence: 5'-Z'ZACGACZACGZZACACGCGZZ-ZAZAGC-3' (SEQ ID NO: 511), wherein Z and Z' are as defined above.

In some embodiments, a PDGF aptamer comprises the sequence: 5'-ZABL$_p$GYZABK$_q$GCGZZYDYAG-3' (SEQ ID NO: 505)
wherein each Z is, independently, a modified pyrimidine;
each B is independently selected from C and a substituted or unsubstituted $C_2$-$C_{10}$ linker;
each L is independently selected from a substituted or unsubstituted $C_2$-$C_{10}$ linker, a hexaethylene glycol linker, and a modified or unmodified nucleotide, wherein p is 1 to 10;
each Y is independently selected from a modified or unmodified pyrimidine;
each K is independently selected from a substituted or unsubstituted $C_2$-$C_{10}$ linker, a hexaethylene glycol linker, and a modified or unmodified nucleotide, wherein q is 1 to 5; and
D is selected from A and a substituted or unsubstituted $C_2$-$C_{10}$ linker.

In some embodiments, a PDGF aptamer comprises the sequence: 5'-XZABL$_n$GYZABL$_n$GCGZZYDYAGBE-3' (SEQ ID NO: 506),
wherein X is selected from a modified or unmodified pyrimidine and a substituted or unsubstituted $C_2$-$C_{10}$ linker, or is absent; and E is selected from G and a substituted or unsubstituted $C_2$-$C_{10}$ linker, or is absent.

An aptamer construct comprising the sequences NZVS (SEQ ID NO 761) and S'V'ZACNN$_m$GCGZZZAZAGCG (SEQ ID NO: 762),
wherein
V is selected from an A, C or G; V' is selected from a C, G or Z, wherein V' is selected from a C, G or Z, wherein V' is complementary to V;
S and S' are independently selected from a C or G, wherein S and S' are complementary to each other;
N is independently selected from any naturally occurring or modified nucleotide;

Z is independently selected from a modified pyrimidine;
m is 1 to 20; and
wherein one or more nucleotide insertions are optionally included.

In some embodiments, Z is a modified uridine. In some embodiments, each Z is independently selected from the C-5 modified pyrimidines as defined herein. In some embodiments, each Z is independently selected from
5-(N-benzylcarboxyamide)-2'-deoxyuridine (BndU),
5-(N-benzylcarboxyamide)-2'-O-methyluridine,
5-(N-benzylcarboxyamide)-2'-fluorouridine,
5-(N-phenethylcarboxyamide)-2'-deoxyuridine (PEdU),
5-(N-thiophenylmethylcarboxyamide)-2'-deoxyuridine (ThdU),
5-(N-isobutylcarboxyamide)-2'-deoxyuridine (iBudU),
5-(N-tyrosylcarboxyamide)-2'-deoxyuridine (TyrdU),
5-(N-3,4-methylenedioxybenzylcarboxyamide)-2'-deoxyuridine (MBndU),
5-(N-4-fluorobenzylcarboxyamide)-2'-deoxyuridine (FBndU),
5-(N-3-phenylpropylcarboxyamide)-2'-deoxyuridine (PPdU),
5-(N-imidizolylethylcarboxyamide)-2'-deoxyuridine (ImdU),
5-(N-isobutylcarboxyamide)-2'-O-methyluridine,
5-(N-isobutylcarboxyamide)-2'-fluorouridine,
5-(N-tryptaminocarboxyamide)-2'-deoxyuridine (TrpdU),
5-(N—R-threoninylcarboxyamide)-2'-deoxyuridine (ThrdU),
5-(N-tryptaminocarboxyamide)-2'-O-methyluridine,
5-(N-tryptaminocarboxyamide)-2'-fluorouridine,
5-(N-[1-(3-trimethylamonium) propyl]carboxyamide)-2'-deoxyuridine chloride,
5-(N-naphthylmethylcarboxyamide)-2'-deoxyuridine (NapdU),
5-(N-naphthylmethylcarboxyamide)-2'-O-methyluridine,
5-(N-naphthylmethylcarboxyamide)-2'-fluorouridine,
5-(N-[1-(2,3-dihydroxypropyl)]carboxyamide)-2'-deoxyuridine),
5-(N-2-naphthylmethylcarboxyamide)-2'-deoxyuridine (2NapdU),
5-(N-2-naphthylmethylcarboxyamide)-2'-O-methyluridine,
5-(N-2-naphthylmethylcarboxyamide)-2'-fluorouridine,
5-(N-1-naphthylethylcarboxyamide)-2'-deoxyuridine (NEdU),
5-(N-1-naphthylethylcarboxyamide)-2'-O-methyluridine,
5-(N-1-naphthylethylcarboxyamide)-2'-fluorouridine,
5-(N-2-naphthylethylcarboxyamide)-2'-deoxyuridine (2NEdU),
5-(N-2-naphthylethylcarboxyamide)-2'-O-methyluridine,
5-(N-2-naphthylethylcarboxyamide)-2'-fluorouridine,
5-(N-3-benzofuranylethylcarboxyamide)-2'-deoxyuridine (BFdU),
5-(N-3-benzofuranylethylcarboxyamide)-2'-O-methyluridine,
5-(N-3-benzofuranylethylcarboxyamide)-2'-fluorouridine,
5-(N-3-benzothiophenylethylcarboxyamide)-2'-deoxyuridine (BTdU),
5-(N-3-benzothiophenylethylcarboxyamide)-2'-O-methyluridine, and
5-(N-3-benzothiophenylethylcarboxyamide)-2'-fluorouridine.

In certain embodiments, portions of the PDGF and/or VEGF aptamer (Y) may not be necessary to maintain binding and certain portions of the contiguous PDGF and/or VEGF aptamer can be modified, including, but not limited to, replacement with a spacer or linker moiety. In these embodiments, for example, Y can be represented as Y'-Q-Y"-Q'-Y''', wherein Y', Y" and Y''' are parts of a PDGF and/or VEGF aptamer or segments of different PDGF and/or VEGF aptamers and Q and/or Q' are spacers or linker molecules that modify certain nucleic acid features of the original PDGF and/or VEGF aptamer. When Q and Q' are not present, Y', Y", and Y''' represent one contiguous PDGF and/or VEGF aptamer (Y).

As used herein a "linker" is a molecular entity that connects two or more molecular entities through covalent bond or non-covalent interactions and can allow spatial separation of the molecular entities in a manner that preserves the functional properties of one or more of the molecular entities. A linker can also be known as a spacer. Appropriate linker sequences will be readily ascertained by those of skill in the art based upon the present disclosure.

As used herein, a linker can comprise one or more molecules or sub-components, selected from the group including, but not limited to, a polynucleotide, a polypeptide, a peptide nucleic acid, a locked nucleic acid, an oligosaccharide, a polysaccharide, an antibody, an affibody, an antibody mimic, an aliphatic, aromatic or heteroaromatic carbon molecule, a polyethylene glycol (PEG) molecule, a cell receptor, a ligand, a lipid, any fragment or derivative of these structures, any combination of the foregoing, or any other chemical structure or component.

In some embodiments, at least one L is a polyethylene glycol linker. In some embodiments, at least one L is a hexaethylene glycol linker. In some embodiments, L is a substituted or unsubstituted $C_2$-$C_{10}$ linker. In some embodiments, p is 1, 2, 3, 4, 5, 6, 7, or 8. In some embodiments, p is 1, 2, or 3. In some embodiments, at least one K is a polyethylene glycol linker. In some embodiments, at least one K is a hexaethylene glycol linker. In some embodiments, K is a substituted or unsubstituted $C_2$-$C_{10}$ linker. In some embodiments, q is 1 or 2. In some embodiments, q is 1.

In various embodiments, m may be 0 to 20, 0 to 19, 0 to 18, 0 to 17, 0 to 16, 0 to 15, 0 to 15, 0 to 14, 0 to 13, 0 to 12, 0 to 11, 0 to 10, 0 to 9, 0 to 8, 0 to 7, 0 to 6, 0 to 5, 0 to 4, or 0 to 3.

In some embodiments, L may be a linker such as an 18-atom hexaethylene glycol linker. In some embodiments, the L may be a combination of nucleotides and a linker. As a nonlimiting example, the following aptamers (SEQ ID NOs 67 and 69) include a hexaethylene glycol (Heg) linker:
(SEQ ID NO. 67) 5'-Bn-Bn-A-C-Heg-G-Bn-Bn-A-C-A-C-G-C-G-Bn-Bn-Bn-A-Bn-A-G-C-G-3'
(SEQ ID NO. 69) 5'-Bn-Bn-A-C-G-Heg-C-G-Bn-Bn-A-C-A-C-G-C-G-Bn-Bn-Bn-A-Bn-A-G-C-G-3'
wherein Bn is benzyl-dU and Heg is a hexaethylene glycol linker.

In some embodiments, an N may be replaced by a linker, such as in the following aptamers:
(SEQ ID NO. 329) 5'-Bn-Bn-A-C-Heg-G-Bn-Bn-A-C-C3-G-C-G-Bn-Bn-Bn-A-Bn-A-G-C-3'
(SEQ ID NO. 408) 5'-Bn-Bn-A-C-Heg-G-Bn-Bn-A-C-C3-C-G-Bn-Bn-Bn-A-Bn-A-G-3'
wherein Bn is benzyl-dU, Heg is a hexaethylene glycol linker and C3 is a three carbon linker.

Further PDGF aptamers were identified using the improved SELEX method for identifying aptamers having slow off-rates as described in Example 5, which describes a representative method for the selection and production of an aptamer that binds PDGF with a slow dissociation rate. A random DNA library composed of napthyl-dU (Nap-dU), dA, dC and dG was used for the selection. PDGF aptamer 5169-4_26 was identified in the screen.

In some embodiments, an aptamer that specifically binds PDGF is provided, wherein the aptamer competes for binding to PDGF with PDGF aptamer 5169-4_26. In some such embodiments, the aptamer comprises at least one modified nucleoside comprising a hydrophobic nucleobase modification. Further, in some such embodiments, the hydrophobic nucleobase modification is a modified pyrimidine. In some embodiments, each modified pyrimidine may be independently selected from 5-(N-benzylcarboxyamide)-2'-deoxyuridine (BndU), 5-(N-benzylcarboxyamide)-2'-O-methyluridine, 5-(N-benzylcarboxyamide)-2'-fluorouridine, 5-(N-phenethylcarboxyamide)-2'-deoxyuridine (PedU), 5-(N-thiophenylmethylcarboxyamide)-2'-deoxyuridine (ThdU), 5-(N-isobutylcarboxyamide)-2'-deoxyuridine (iBudU), 5-(N-isobutylcarboxyamide)-2'-O-methyluridine, 5-(N-isobutylcarboxyamide)-2'-fluorouridine, 5-(N-tryptaminocarboxyamide)-2'-deoxyuridine (TrpdU), 5-(N-tryptaminocarboxyamide)-2'-O-methyluridine, 5-(N-tryptaminocarboxyamide)-2'-fluorouridine, 5-(N-[1-(3-trimethylamonium) propyl]carboxyamide)-2'-deoxyuridine chloride, 5-(N-naphthylmethylcarboxyamide)-2'-deoxyuridine (NapdU), 5-(N-naphthylmethylcarboxyamide)-2'-O-methyluridine, 5-(N-naphthylmethylcarboxyamide)-2'-fluorouridine, and 5-(N-[1-(2,3-dihydroxypropyl)]carboxyamide)-2'-deoxyuridine).

In some embodiments, an aptamer that specifically bind PDGF is provided, wherein the aptamer comprises the sequence: 5'-ACAL$_n$ZGZAZGL$_m$ZLZ-3' (SEQ ID NO. 512);
wherein each Z is, independently, a modified pyrimidine; each L is independently selected from a substituted or unsubstituted $C_2$-$C_{50}$ linker, a polyethylene glycol linker, and a modified or unmodified nucleotide; n is 1 to 5; and m is 1 to 10.

In some embodiments, each is independently selected from 5-(N-benzylcarboxyamide)-2'-deoxyuridine (BndU), 5-(N-benzylcarboxyamide)-2'-O-methyluridine, 5-(N-benzylcarboxyamide)-2'-fluorouridine, 5-(N-phenethylcarboxyamide)-2'-deoxyuridine (PedU), 5-(N-thiophenylmethylcarboxyamide)-2'-deoxyuridine (ThdU), 5-(N-isobutylcarboxyamide)-2'-deoxyuridine (iBudU), 5-(N-isobutylcarboxyamide)-2'-O-methyluridine, 5-(N-isobutylcarboxyamide)-2'-fluorouridine, 5-(N-tryptaminocarboxyamide)-2'-deoxyuridine (TrpdU), 5-(N-tryptaminocarboxyamide)-2'-O-methyluridine, 5-(N-tryptaminocarboxyamide)-2'-fluorouridine, 5-(N-[1-(3-trimethylamonium) propyl]carboxyamide)-2'-deoxyuridine chloride, 5-(N-naphthylmethylcarboxyamide)-2'-deoxyuridine (NapdU), 5-(N-naphthylmethylcarboxyamide)-2'-O-methyluridine, 5-(N-naphthylmethylcarboxyamide)-2'-fluorouridine, and 5-(N-[1-(2,3-dihydroxypropyl)]carboxyamide)-2'-deoxyuridine). In some embodiments, at least one, at least two, at least three, at least four, or each Z is 5-(N-naphthylmethylcarboxyamide)-2'-deoxyuridine (NapdU). In some embodiments, n is 1, 2, 3, 4, or 5. In some embodiments, m is 1, 2, 3, 4, 5, 6, 7, 8, 9, or 10. In some embodiments, n is 3. In some embodiments, m is 4. In some such embodiments, each L is independently selected from a modified nucleotide, an unmodified nucleotide, and a C3 linker.

A $C_2$-$C_{50}$ linker or spacer may be a backbone comprising a chain of 2 to 50 carbon atoms ($C_2$-$C_{50}$) (saturated, unsaturated, straight chain, branched or cyclic), 0 to 10 aryl groups, 0 to 10 heteroaryl groups, and 0 to 10 heterocyclic groups, optionally comprising an ether (—O—) linkage, (e.g., one or more alkylene glycol units, including but not limited to one or more ethylene glycol units —O—(CH$_2$CH$_2$O)—; one or more 1,3-propane diol units —O—(CH$_2$CH$_2$CH$_2$O)—, etc.); an amine (—NH—) linkage; an amide (—NC(O)—) linkage; and a thioether (—S—) linkage; etc.; wherein each backbone carbon atom may be independently unsubstituted (i.e., comprising —H substituents) or may be substituted with one or more groups selected from a $C_1$ to $C_3$ alkyl, —OH, —NH$_2$, —SH, —O—($C_1$ to $C_6$ alkyl), —S—($C_1$ to $C_6$ alkyl), halogen, —OC(O)($C_1$ to $C_6$ alkyl), —NH—($C_1$ to $C_6$ alkyl), and the like. In some embodiments, a $C_2$-$C_{50}$ linker is a $C_2$-$C_{20}$ linker, a $C_2$-$C_{10}$ linker, a $C_2$-$C_8$ linker, a $C_2$-$C_6$ linker, a $C_2$-$C_5$ linker, a $C_2$-$C_4$ linker, or a $C_3$ linker, wherein each carbon may be independently substituted as described above.

In some embodiments, one or more nucleosides of a PDGF aptamer comprise a modification selected from a 2'-position sugar modification (such as a 2'-amino (2'-NH$_2$), a 2'-fluoro (2'-F), or a 2'-O-methyl (2'-OMe)), a modification at a cytosine exocyclic amine, an internucleoside linkage modification, and a 5-methyl-cytosine. In some embodiments, a PDGF aptamer comprises a 3' cap, a 5' cap, and/or an inverted deoxythymidine at the 3' terminus.

In some embodiments, a PDGF aptamer comprises at least one modified internucleoside linkage. In some embodiments, at least one, at least two, at least three, at least four, or at least five internucleoside linkages are phosphorothioate linkages.

In some embodiments, a PDGF aptamer has a sequence selected from the sequences shown in Tables 1, 2 and 6 to 9 (SEQ ID NOS: 1 to 499 and 517 to 545). In some embodiments, a PDGF aptamer has a sequence selected from the sequences shown in Table 1 and the sequences shown in Tables 6 to 9 that bind PDGF with an affinity ($K_d$) of less than 10 nM. In some embodiments, a PDGF aptamer has a sequence that is at least 90%, at least 91%, at least 92%, at least 93%, at least 94%, at least 95%, at least 96%, at least 97%, at least 98%, at least 99%, or 100% identical to the sequences shown in Tables 1, 2, and 6 to 9 (SEQ ID NOS: 1 to 1 to 499 and 517 to 545). In some embodiments, a PDGF aptamer has a sequence that is at least 90%, at least 91%, at least 92%, at least 93%, at least 94%, at least 95%, at least 96%, at least 97%, at least 98%, at least 99%, or 100% identical to the sequences shown in Table 1 and the sequences shown in Tables 6 to 9 that bind PDGF with an affinity ($K_d$) of less than 10 nM.

The terms "sequence identity", "percent sequence identity", "percent identity", "% identical", "% identity", and variations thereof, when used in the context of two nucleic acid sequences, are used interchangeably to refer to the number of nucleotide bases that are the same in a query nucleic acid or a portion of a query nucleic acid, when it is compared and aligned for maximum correspondence to a reference nucleic acid, divided by either (1) the number of nucleotide bases in the query sequence between and including the most 5' corresponding (i.e., aligned) nucleotide base and the most 3' corresponding (i.e., aligned) nucleotide base, or (2) the total length of the reference sequence, whichever is greater. Exemplary alignment of sequences for comparison can be conducted, e.g., by the local homology algorithm of Smith and Waterman (1981) Adv. Appl. Math. 2:482, by the homology alignment algorithm of Needleman and Wunsch (1970) J. Mol. Biol. 48:443, by the search for similarity method of Pearson and Lipman (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally, Ausubel, F. M. et al. (1987), Current Protocols in Molecular Biology, Greene Publishing Assoc. and Wiley-Interscience).

One example of an algorithm that is suitable for determining percent sequence identity is the algorithm used in the basic local alignment search tool (hereinafter "BLAST"), see, e.g. Altschul et al. (1990) J. Mol. Biol. 215:403 and Altschul et al. (1997) Nucleic Acids Res. 15:3389. Software for performing BLAST analyses is publicly available through the National Center for Biotechnology Information (hereinafter "NCBI"). The default parameters used in determining sequence identity using the software available from NCBI, e.g., BLASTN (for nucleotide sequences) are described in McGinnis et al. (2004) Nucleic Acids Res. 32:W20.

As used herein, when describing the percent identity of a nucleic acid, such as a PDGF aptamer, the sequence of which is at least, for example, about 95% identical to a reference nucleotide sequence, it is intended that the nucleic acid sequence is identical to the reference sequence except that the nucleic acid sequence may include up to five point mutations per each 100 nucleotides of the reference nucleic acid sequence. In other words, to obtain a desired nucleic acid sequence, the sequence of which is at least about 95% identical to a reference nucleic acid sequence, up to 5% of the nucleotides in the reference sequence may be deleted or substituted with another nucleotide, or some number of nucleotides up to 5% of the total number of nucleotides in the reference sequence may be inserted into the reference sequence (referred to herein as an insertion). These mutations of the reference sequence to generate the desired sequence may occur at the 5' or 3' terminal positions of the reference nucleotide sequence or anywhere between those terminal positions, interspersed either individually among nucleotides in the reference sequence or in one or more contiguous groups within the reference sequence. Further, it is intended that a nucleotide base is considered "identical" for the purposes of determining percent identity, when the nucleotide base (1) is the same as the nucleotide base in the reference sequence, or (2) is derived from the nucleotide base in the reference sequence, or (3) is derived from the same nucleotide base from which the nucleotide base in the reference sequence is derived. For example, 5-methyl cytosine is considered to be "identical" to cytosine for the purposes of calculating percent identity. Similarly, the modified uridines shown in FIG. 12 are considered to be identical to one another for the purpose of determining percent identity. The reference sequence may be any one of the nucleotide sequences shown in SEQ ID NOS: 1 to 437.

In some embodiments, the present disclosure provides a PDGF aptamer that, upon binding PDGF, modulates a PDGF function. In some embodiments, a PDGF aptamer described herein inhibits PDGF-mediated phosphorylation of a PDGF receptor, such as PDGF Rα or PDGF Rβ. In some embodiments, a PDGF aptamer described herein inhibits PDGF-mediated phosphorylation of PDGF RP. In various embodiments, the PDGF aptamer modulates a PDGF function in vivo, such as inhibiting PDGF-mediated receptor phosphorylation in vivo. In various embodiments, the PDGF aptamer has a sequence selected from the sequences of SEQ ID NOS: 1 to 437. In various embodiments, the PDGF aptamer is selected from the aptamers shown in Tables 1 and 2. In various embodiments, the PDGF aptamer is selected from the aptamers shown in Table 1. In some embodiments, the PDGF aptamer comprises at least 12, at least 13, at least 14, at least 15, at least 16, at least 17, at least 18, at least 19, at least 20, at least 21, at least 21, at least 22, at least 23, at least 24, at least 25, at least 26, at least 27, at least 28, at least 29, or at least 30 contiguous nucleotides of a sequence selected from SEQ ID NOS: 1 to 1 to 499 and 517 to 545. In some embodiments, a PDGF aptamer consists of at least 12, at least 13, at least 14, at least 15, at least 16, at least 17, at least 18, at least 19, at least 20, at least 21, at least 21, at least 22, at least 23, at least 24, at least 25, at least 26, at least 27, at least 28, at least 29, or at least 30 contiguous nucleotides that are identical in nucleobase sequence to a sequence selected from SEQ ID NOS: 1 to 1 to 499 and 517 to 545. In some embodiments, the PDGF aptamer comprises at least 12, at least 13, at least 14, at least 15, at least 16, at least 16, at least 17, at least 18, at least 19, at least 20, at least 21, at least 21, at least 22, at least 23, at least 24, at least 25, at least 26, at least 27, at least 28, at least 29, or at least 30 contiguous nucleotides of an aptamer shown in Table 1, 2, 6, 7, 8 or 9. In some embodiments, the PDGF aptamer comprises at least 12, at least 13, at least 14, at least 15, at least 16, at least 17, at least 18, at least 19, at least 20, at least 21, at least 21, at least 22, at least 23, at least 24, at least 25, at least 26, at least 27, at least 28, at least 29, or at least 30 contiguous nucleotides of an aptamer shown in Table 1 or an aptamer shown in one of Tables 6 to 9 that binds PDGF with an affinity ($K_d$) of less than 10 nM. In some embodiments, a PDGF aptamer consists of at least 12, at least 13, at least 14, at least 15, at least 16, at least 17, at least 18, at least 19, at least 20, at least 21, at least 21, at least 22, at least 23, at least 24, at least 25, at least 26, at least 27, at least 28, at least 29, or at least 30 contiguous nucleotides of an aptamer shown in Table 1, 2, 6, 7, 8 or 9. In some embodiments, a PDGF aptamer consists of at least 12, at least 13, at least 14, at least 15, at least 16, at least 17, at least 18, at least 19, at least 20, at least 21, at least 21, at least 22, at least 23, at least 24, at least 25, at least 26, at least 27, at least 28, at least 29, or at least 30 contiguous nucleotides of an aptamer shown in Table 1 or an aptamer shown in one of Tables 6 to 9 that binds PDGF with an affinity ($K_d$) of less than 10 nM.

In some embodiments, a PDGF aptamer has a nucleobase sequence selected from the sequences of SEQ ID NOS. 500 to 512; 761 and 762. In some embodiments, a PDGF aptamer has the sequence of any one of SEQ ID NOS: 1 to 1 to 499 and 517 to 545. In some embodiments, a PDGF aptamer is at least 95% identical, at least 90% identical, at least 85% identical, at least 80% identical, or at least 75% identical to any one of SEQ ID NOS: 1 to 499 and 517 to 545. In any of the embodiments herein, a PDGF aptamer may comprise additional nucleotides or other chemical moieties on the 5' end, the 3' end, or both the 5' and the 3' end of the aptamer.

The PDGF aptamer can contain any number of nucleotides in addition to the PDGF binding region. In various embodiments, the PDGF aptamer can include up to about 100 nucleotides, up to about 95 nucleotides, up to about 90 nucleotides, up to about 85 nucleotides, up to about 80 nucleotides, up to about 75 nucleotides, up to about 70 nucleotides, up to about 65 nucleotides, up to about 60 nucleotides, up to about 55 nucleotides, up to about 50 nucleotides, up to about 45 nucleotides, up to about 40 nucleotides, up to about 35 nucleotides, up to about 30 nucleotides, up to about 25 nucleotides, or up to about 20 nucleotides.

In some embodiments, the PDGF aptamer is selected from an aptamer that has similar binding characteristics and ability to treat PDGF associated atherosclerosis, macular degeneration, fibrosis, or cancer conditions as an aptamer selected from SEQ ID NOS: 1 to 499 and 517 to 545. In some embodiments, a PDGF aptamer binds to the same region of a PDGF-B monomer (in the context of a PDGF-BB or PDGF-AB dimer) as an aptamer selected from the aptamers shown in Tables 1, 2, and 6 to 9. In some embodiments, a PDGF aptamer binds to the same region of a PDGF-B monomer (in the context of a PDGF-BB or PDGF-AB dimer) as an aptamer selected from the aptamers shown in Table 1. In some embodiments, a PDGF aptamer binds to the same region of a PDGF-B monomer (in the context of a PDGF-BB or PDGF-AB dimer) as an aptamer selected from the aptamers shown in Table 6. In some embodiments, a PDGF aptamer binds to the same region of a PDGF-B monomer (in the context of a PDGF-BB or PDGF-AB dimer) as PDGF aptamer 4149-8_260. In some embodiments, a PDGF aptamer binds to a region of PDGF-B comprising amino acids 24 to 86 of PDGF-B. In some such embodiments, the PDGF aptamer competes for binding to PDGF with PDGF aptamer 4149-8_260. In some embodiments, a PDGF aptamer binds to PDGF-B with less than 15%, less than 14%, less than 13%, less than 12%, less than 11%, less than 10%, less than 9%, less than 8%, less than 7%, or less than 6% polar contacts to protein contact atoms. Polar contacts are defined as the sum of hydrogen bonds and charge-charge interactions. In some embodiments, a PDGF aptamer binds to PDGF-B with a ratio of polar contacts to interface area of less than 0.01, less than 0.009, less than 0.008, less than 0.007, or less than 0.006. In some embodiments, a PDGF aptamer binds to the same region of a PDGF-B monomer (in the context of a PDGF-BB or PDGF-AB dimer) as PDGF aptamer 5169-4_26.

In some embodiments, a PDGF aptamer has any combination of the following characteristics:
(a) binds to a region of PDGF-B comprising amino acids 24 to 86 of PDGF-B;
(b) competes for binding to PDGF with PDGF aptamer 4149-8_260;
(c) competes for binding to PDGF with PDGF aptamer 5169-4_26;
(d) binds to PDGF-B with a ratio of polar contacts to interface area of less than 0.01, less than 0.009, less than 0.008, less than 0.007, or less than 0.006; and/or
(e) binds to PDGF-B with less than 15%, less than 14%, less than 13%, less than 12%, less than 11%, less than 10%, less than 9%, less than 8%, less than 7%, or less than 6% polar contacts to protein contact atoms.

The PDGF aptamer can be selected to have any suitable dissociation constant ($K_d$) for PDGF. In some embodiments, a PDGF aptamer has a dissociation constant ($K_d$) for PDGF of less than 30 nM, less than 25 nM, less than 20 nM, less than 15 nM, less than 10 nM, less than 9 nM, less than 8 nM, less than 7 nM, less than 6 nM, less than 5 nM, less than 4 nM, less than 3 nM, less than 2 nM, or less than 1 nM. Dissociation constants may be determined with a binding assay using a multi-point titration and fitting the equation $y=(max-min)(Protein)/(K_d+Protein)+min$ as described in Example 3, below. In some embodiments, the PDGF aptamer is an aptamer with a K that is less than or equal to the $K_d$ of an aptamer shown in any one of Tables 1, 2 or 6 to 9. In some embodiments, the PDGF aptamer is an aptamer with a $K_d$ that is less than or equal to the $K_d$ of an aptamer shown in Table 1 or Table 6.

Aptamer 4149-8_1 binds in a 1:1 stoichiometry with a PDGF monomer. Since PDGF forms a tight homodimer that is required for reaction with its target receptors, a more efficient inhibition of PDGF activity might be achieved by using a dimeric or other multimeric form of aptamer 4149-8_1. Thus, in some embodiments, the PDGF aptamer is a multimerization of any combination of the sequences of aptamer 4149-8_1, 4149-8_379, and SEQ ID NOS 500 to 512. In some embodiments, an aptamer construct comprises a first aptamer selected from any of the PDGF aptamers described herein, and a second aptamer comprising any of the PDGF aptamers described herein, wherein the first aptamer and the second aptamer may be the same or different. The first aptamer and the second aptamer of the PDGF aptamer construct may be covalently or noncovalently linked. Nonlimiting exemplary linkages are known in the art and/or are described herein. In some embodiments, a PDGF aptamer construct may be capable of binding two PDGF monomers simultaneously. In some embodiments, a PDGF aptamer construct binds PDGF with an affinity ($K_d$) of less than 10 nM.

Exemplary VEGF Aptamers

The VEGF aptamers of the instant disclosure were identified using the improved SELEX method for identifying aptamers having slow off-rates as described in Example 7, which describes a representative method for the selection and production of an aptamer that binds VEGF with a slow dissociation rate.

We truncated a clone from a Nap-dU VEGF-121 SELEX experiment to a minimal sequence of 29 nucleotides. This SOMAmer binds to both VEGF-121 and VEGF-165 with high affinity ($K_d$ values of 90 pM and 20 pM, respectively). The SOMAmer also potently inhibits the ability of both VEGF isoforms to induce VEGFR2 phosphorylation in human umbilical vein endothelial cells in vitro (see Example 9), supporting the notion that it binds to and blocks the receptor-binding domain on VEGF.

The present disclosure provides the first identification of an inhibitory aptamer to VEGF-121. Thus, the present VEGF aptamers represent broad inhibitors of VEGF, similar to protein-based drugs like bevacizumab (Avastin®), ranibizumab (Lucentis®) and aflibercept (Eylea®) (Papadopoulos et al. (2012) Angiogenesis 15:171; Yu et al. (2011) Biochem. Biophys. Res. Commun. 408:276. Thus, the present VEGF aptamers may more effectively inhibit VEGF signaling than Macugen®, which is a selective inhibitor of VEGF-165.

A truncated clone from the successful Nap-dU VEGF-121 SELEX experiment provided a sequence of 29 nucleotides. This aptamer (or SOMAmer) (4867-31 binds to both VEGF-121 and VEGF-165 with high affinity ($K_d$ values of 90 pM and 20 pM, respectively). This SOMAmer also potently inhibits the ability of both VEGF isoforms to induce VEGFR2 phosphorylation in human umbilical vein endothelial cells in vitro, supporting the concept that it binds to and blocks the receptor-binding domain on VEGF.

Aptamer 4867-31_192 binds in a 1:1 stoichiometry with a VEGF monomer. Since VEGF forms a tight homodimer that is required for reaction with its target receptors, a more efficient inhibition of VEGF activity might be achieved by using a dimeric or other multimeric form of aptamer 4867-31_192. Thus, in some embodiments, the VEGF aptamer is a multimerization of any combination of the sequences of aptamer 4867-31_192, SEQ ID NOS 513 to 516. In some embodiments, an aptamer construct comprises a first aptamer selected from any of the VEGF aptamers described herein, and a second aptamer comprising any of the VEGF aptamers described herein, wherein the first aptamer and the second aptamer may be the same or different. The first aptamer and the second aptamer of the VEGF aptamer construct may be covalently or noncovalently linked. Nonlimiting exemplary linkages are known in the art and/or are described herein. In some embodiments, a VEGF aptamer construct may be capable of binding two VEGF monomers simultaneously. In some embodiments, a VEGF aptamer construct binds VEGF with an affinity ($K_d$) of less than 10 nM.

In some embodiments, a VEGF aptamer binds VEGF-121 with a $K_d$ of less than 10 nM. In some embodiments, the VEGF aptamer comprises one or more modified nucleotides.

In some embodiments, the VEGF aptamer comprises one or more modified nucleotides comprising hydrophobic modification. In some embodiments, the VEGF aptamer comprises one or more modified pyrimidines. In some embodiments, the VEGF aptamer comprises one or more modified pyrimidines shown in FIG. 12. In some embodiments, the VEGF aptamer comprises one or more modified pyrimidines shown in FIG. 12, groups II to V. In some embodiments, the VEGF aptamer comprises one or more modified pyrimidines shown in FIG. 12, groups III to V. In some embodiments, the VEGF aptamer comprises one or more modified pyrimidines shown in FIG. 12, groups III and IV. In some embodiments, the VEGF aptamer comprises one or more (N-naphthylmethylcarboxyamide)-2'-deoxyuridines (NapdUs).

In some embodiments, a VEGF aptamer comprises the sequence:

```
                                          (SEQ ID NO. 513)
     5'-GZZZQAAEZECZZEZDRGAZZZAAAZGG-3'
``` wherein each Z is a modified pyrimidine;
Q is selected from any modified or unmodified nucleotide and a substituted or unsubstituted $C_2$-$C_{50}$ linker, or is absent;
each E is independently selected from a G and a substituted or unsubstituted $C_2$-$C_{50}$ linker;
D is selected from A and a substituted or unsubstituted $C_2$-$C_{50}$ linker; and
R is selected from any modified or unmodified nucleotide and a substituted or unsubstituted $C_2$-$C_{50}$ linker.

In some embodiments, a VEGF aptamer comprises a sequence selected from:

```
                                          (SEQ ID NO. 514)
     5'-CGZZQAAEZECZZEZDRGAZZZAAAZG-3';

(SEQ ID NO. 513)
     5'-GZZZQAAEZECZZEZDRGAZZZAAAZGG-3';

(SEQ ID NO. 515)
     5'-CGZZZQAAEZECZZEZDRGAZZZAAAZGG-3';
and
                                          (SEQ ID NO. 516)
     5'-CCGZZZQAAEZECZZEZDRGAZZZAAAZGG-3';
``` wherein Z, Q, E, D, and R are as defined above.

In some embodiments, Z is a modified uridine. In some embodiments, each Z is independently selected from the C-5 modified pyrimidines as defined herein. In some embodiments, each Z is independently selected from:
5-(N-benzylcarboxyamide)-2'-deoxyuridine (BndU),
5-(N-benzylcarboxyamide)-2'-O-methyluridine,
5-(N-benzylcarboxyamide)-2'-fluorouridine,
5-(N-phenethylcarboxyamide)-2'-deoxyuridine (PEdU),
5-(N-thiophenylmethylcarboxyamide)-2'-deoxyuridine (ThdU),
5-(N-isobutylcarboxyamide)-2'-deoxyuridine (iBudU),
5-(N-tyrosylcarboxyamide)-2'-deoxyuridine (TyrdU),
5-(N-3,4-methylenedioxybenzylcarboxyamide)-2'-deoxyuridine (MBndU),
5-(N-4-fluorobenzylcarboxyamide)-2'-deoxyuridine (FBndU),
5-(N-3-phenylpropylcarboxyamide)-2'-deoxyuridine (PPdU),
5-(N-imidizolylethylcarboxyamide)-2'-deoxyuridine (ImdU),
5-(N-isobutylcarboxyamide)-2'-O-methyluridine,
5-(N-isobutylcarboxyamide)-2'-fluorouridine,
5-(N-tryptaminocarboxyamide)-2'-deoxyuridine (TrpdU),
5-(N—R-threoninylcarboxyamide)-2'-deoxyuridine (ThrdU),
5-(N-tryptaminocarboxyamide)-2'-O-methyluridine,
5-(N-tryptaminocarboxyamide)-2'-fluorouridine,
5-(N-[1-(3-trimethylamonium) propyl]carboxyamide)-2'-deoxyuridine chloride,
5-(N-naphthylmethylcarboxyamide)-2'-deoxyuridine (NapdU),
5-(N-naphthylmethylcarboxyamide)-2'-O-methyluridine,
5-(N-naphthylmethylcarboxyamide)-2'-fluorouridine,
5-(N-[1-(2,3-dihydroxypropyl)]carboxyamide)-2'-deoxyuridine),
5-(N-2-naphthylmethylcarboxyamide)-2'-deoxyuridine (2NapdU),
5-(N-2-naphthylmethylcarboxyamide)-2'-O-methyluridine,
5-(N-2-naphthylmethylcarboxyamide)-2'-fluorouridine,
5-(N-1-naphthylethylcarboxyamide)-2'-deoxyuridine (NEdU),
5-(N-1-naphthylethylcarboxyamide)-2'-O-methyluridine,
5-(N-1-naphthylethylcarboxyamide)-2'-fluorouridine,
5-(N-2-naphthylethylcarboxyamide)-2'-deoxyuridine (2NEdU),
5-(N-2-naphthylethylcarboxyamide)-2'-O-methyluridine,
5-(N-2-naphthylethylcarboxyamide)-2'-fluorouridine,
5-(N-3-benzofuranylethylcarboxyamide)-2'-deoxyuridine (BFdU),
5-(N-3-benzofuranylethylcarboxyamide)-2'-O-methyluridine,
5-(N-3-benzofuranylethylcarboxyamide)-2'-fluorouridine,
5-(N-3-benzothiophenylethylcarboxyamide)-2'-deoxyuridine (BTdU),
5-(N-3-benzothiophenylethylcarboxyamide)-2'-O-methyluridine, and
5-(N-3-benzothiophenylethylcarboxyamide)-2'-fluorouridine.

In some embodiments, each Z is independently selected from the modified pyrimidines shown in FIG. 12, groups II to V. In some embodiments, each Z is independently selected from the modified pyrimidines shown in FIG. 12, groups III to V. In some embodiments, at least one, at least two, at least three, at least four, at least five, at least six, at least seven, or at least eight Zs are 5-(N-naphthylmethylcarboxyamide)-2'-deoxyuridine (NapdU). In some embodiments, each Z is independently selected from the modified pyrimidines shown in FIG. 12, groups III to IV. In some embodiments, each Z is 5-(N-naphthylmethylcarboxyamide)-2'-deoxyuridine (NapdU).

A $C_2$-$C_{50}$ linker or spacer may be a backbone comprising a chain of 2 to 50 carbon atoms ($C_2$-$C_{50}$) (saturated, unsaturated, straight chain, branched or cyclic), 0 to 10 aryl groups, 0 to 10 heteroaryl groups, and 0 to 10 heterocyclic groups, optionally comprising an ether (—O—) linkage, (e.g., one or more alkylene glycol units, including but not limited to one or more ethylene glycol units —O—($CH_2CH_2O$)—; one or more 1,3-propane diol units —O—($CH_2CH_2CH_2O$)—, etc.); an amine (—NH—) linkage; an amide (—NC(O)—) linkage; and a thioether (—S—) linkage; etc.; wherein each backbone carbon atom may be independently unsubstituted (i.e., comprising —H substituents) or may be substituted with one or more groups selected from a $C_1$ to $C_3$ alkyl, —OH, —NH$_2$, —SH, —O—($C_1$ to $C_6$ alkyl), —S—($C_1$ to $C_6$ alkyl), halogen, —OC(O)($C_1$ to $C_6$ alkyl), —NH—($C_1$ to $C_6$ alkyl), and the like. In some embodiments, a $C_2$-$C_{50}$ linker is a $C_2$-$C_{20}$ linker, a $C_2$-$C_{10}$ linker, a $C_2$-$C_8$ linker, a $C_2$-$C_6$ linker, a $C_2$-$C_5$ linker, a $C_2$-$C_4$ linker, or a $C_3$ linker, wherein each carbon may be independently substituted as described above.

In some embodiments, each substituted or unsubstituted $C_2$-$C_{50}$ linker is independently selected from a substituted or unsubstituted $C_2$-$C_{20}$ linker, a substituted or unsubstituted $C_2$-$C_{10}$ linker, a substituted or unsubstituted $C_2$-$C_8$ linker, a substituted or unsubstituted $C_2$-$C_6$ linker, a substituted or unsubstituted $C_2$-$C_5$ linker, a substituted or unsubstituted $C_2$-$C_4$ linker, and a substituted or unsubstituted $C_3$ linker. In some embodiments, each substituted or unsubstituted $C_2$-$C_{50}$ linker is a substituted or unsubstituted $C_2$-$C_{10}$ linker. In some such embodiments, each substituted or unsubstituted $C_2$-$C_{10}$ linker is a substituted or unsubstituted $C_2$-$C_8$ linker, a substituted or unsubstituted $C_2$-$C_6$ linker, a substituted or unsubstituted $C_2$-$C_5$ linker, a substituted or unsubstituted $C_2$-$C_4$ linker, or a substituted or unsubstituted $C_3$ linker.

In some embodiments, one or more nucleosides of a VEGF aptamer comprise a modification selected from a 2'-position sugar modification (such as a 2'-amino (2'-NH$_2$), a 2'-fluoro (2'-F), or a 2'-O-methyl (2'-OMe)), a modification at a cytosine exocyclic amine, an internucleoside linkage modification, and a 5-methyl-cytosine. In some embodiments, a VEGF aptamer comprises a 3' cap, a 5' cap, and/or an inverted deoxythymidine at the 3' terminus.

In some embodiments, a VEGF aptamer comprises at least one modified internucleoside linkage. In some embodiments, at least one, at least two, at least three, at least four, or at least five internucleoside linkages are phosphorothioate linkages.

In some embodiments, a VEGF aptamer has a sequence selected from the sequences shown in Tables 10 to 14. In some embodiments, a VEGF aptamer has a sequence selected from the sequences shown in Tables 10 to 14 that have a $K_d$ of less than 10 nM. In some embodiments, a VEGF aptamer has a sequence that is at least 90%, at least 91%, at least 92%, at least 93%, at least 94%, at least 95%, at least 96%, at least 97%, at least 98%, at least 99%, or 100% identical to the sequences shown in Tables 10 to 14. In some embodiments, a VEGF aptamer has a sequence that is at least 90%, at least 91%, at least 92%, at least 93%, at least 94%, at least 95%, at least 96%, at least 97%, at least 98%, at least 99%, or 100% identical to the sequences shown in Tables 10 to 14 that have a $K_d$ of less than 10 nM. Percent identity is determined as described above for PDGF aptamers, except that the reference sequences are the VEGF aptamer sequences shown in Tables 10 to 14, such as the sequences that have a $K_d$ of less than 10 nM.

In some embodiments, the present disclosure provides a VEGF aptamer that, upon binding VEGF, modulates a VEGF function. In some embodiments, a VEGF aptamer inhibits VEGF-mediated phosphorylation of a VEGF receptor, such as VEGFR1 or VEGFR2. In some embodiments, a VEGF aptamer inhibits VEGF-mediated phosphorylation of VEGF receptor. In various embodiments, the VEGF aptamer modulates a VEGF function in vivo, such as inhibiting VEGF-mediated receptor phosphorylation in vivo. In various embodiments, the VEGF aptamer has a sequence selected from the sequences shown in Tables 10 to 14. In various embodiments, the VEGF aptamer is selected from the aptamers shown in Tables 10 to 14 that have a $K_d$ of less than 10 nM. In various embodiments, the VEGF aptamer is selected from the aptamers shown in Tables 10 to 14. In some embodiments, the VEGF aptamer comprises at least 12, at least 13, at least 14, at least 15, at least 16, at least 17, at least 18, at least 19, at least 20, at least 21, at least 21, at least 22, at least 23, at least 24, at least 25, at least 26, at least 27, at least 28, at least 29, or at least 30 contiguous nucleotides of a sequence shown in Tables 10 to 14 that have a $K_d$ of less than 10 nM. In some embodiments, a VEGF aptamer consists of at least 12, at least 13, at least 14, at least 15, at least 16, at least 17, at least 18, at least 19, at least 20, at least 21, at least 21, at least 22, at least 23, at least 24, at least 25, at least 26, at least 27, at least 28, at least 29, or at least 30 contiguous nucleotides that are identical in nucleobase sequence to a sequence shown in Tables 10 to 14 that have a $K_d$ of less than 10 nM. In some embodiments, the VEGF aptamer comprises at least 12, at least 13, at least 14, at least 15, at least 16, at least 17, at least 18, at least 19, at least 20, at least 21, at least 21, at least 22, at least 23, at least 24, at least 25, at least 26, at least 27, at least 28, at least 29, or at least 30 contiguous nucleotides of an aptamer shown in Tables 10 to 14. In some embodiments, the VEGF aptamer comprises at least 12, at least 13, at least 14, at least 15, at least 16, at least 17, at least 18, at least 19, at least 20, at least 21, at least 21, at least 22, at least 23, at least 24, at least 25, at least 26, at least 27, at least 28, at least 29, or at least 30 contiguous nucleotides of an aptamer shown in Tables 10 to 14 that have a $K_d$ of less than 10 nM. In some embodiments, a VEGF aptamer consists of at least 12, at least 13, at least 14, at least 15, at least 16, at least 17, at least 18, at least 19, at least 20, at least 21, at least 21, at least 22, at least 23, at least 24, at least 25, at least 26, at least 27, at least 28, at least 29, or at least 30 contiguous nucleotides of an aptamer shown in Tables 10 to 14. In some embodiments, a VEGF aptamer consists of at least 12, at least 13, at least 14, at least 15, at least 16, at least 17, at least 18, at least 19, at least 20, at least 21, at least 21, at least 22, at least 23, at least 24, at least 25, at least 26, at least 27, at least 28, at least 29, or at least 30 contiguous nucleotides of an aptamer shown in Tables 10 to 14 that have a $K_d$ of less than 10 nM.

In any of the embodiments herein, a VEGF aptamer may comprise additional nucleotides or other chemical moieties on the 5' end, the 3' end, or both the 5' and the 3' end of the aptamer.

The VEGF aptamer can contain any number of nucleotides in addition to the VEGF binding region. In various embodiments, the VEGF aptamer can include up to about 100 nucleotides, up to about 95 nucleotides, up to about 90 nucleotides, up to about 85 nucleotides, up to about 80 nucleotides, up to about 75 nucleotides, up to about 70 nucleotides, up to about 65 nucleotides, up to about 60 nucleotides, up to about 55 nucleotides, up to about 50 nucleotides, up to about 45 nucleotides, up to about 40 nucleotides, up to about 35 nucleotides, up to about 30 nucleotides, up to about 25 nucleotides, or up to about 20 nucleotides.

In some embodiments, the VEGF aptamer is selected from an aptamer that has similar binding characteristics and ability to treat VEGF associated atherosclerosis, macular degeneration, fibrosis, and cancer conditions as an aptamer shown in Tables 10 to 14 have a $K_d$ of less than 10 nM. In some embodiments, a VEGF aptamer binds to the same region of VEGF-121 as an aptamer selected from the aptamers shown in Tables 10 to 14 that have a $K_d$ of less than 10 nM. In some embodiments, a VEGF aptamer binds to the same region of a VEGF-121 as a VEGF aptamer shown in Table 10, 11, 12, 13 or 14 that have a $K_d$ of less than 10 nM. In some embodiments, a VEGF aptamer binds to the same region of VEGF-121 as VEGF aptamer 4867-31_183.

The VEGF aptamer can be selected to have any suitable dissociation constant ($K_d$) for VEGF. In some embodiments, a VEGF aptamer has a dissociation constant ($K_d$) for VEGF-121 of less than 30 nM, less than 25 nM, less than 20 nM, less than 15 nM, less than 10 nM, less than 9 nM, less than 8 nM, less than 7 nM, less than 6 nM, less than 5 nM, less than 4 nM, less than 3 nM, less than 2 nM, or less than 1 nM. Dissociation constants may be determined with a binding assay using a multi-point titration and fitting the equation y=(max−min)(Protein)/($K_d$+Protein)+min as described in Example 3, below.

In some embodiments, an aptamer construct comprises a first aptamer selected from any of the VEGF aptamers described herein, and a second aptamer comprising any of the VEGF aptamers described herein, wherein the first aptamer and the second aptamer may be the same or different. The first aptamer and the second aptamer of the VEGF aptamer construct may be covalently or noncovalently linked. Nonlimiting exemplary linkages are known in the art and/or are described herein. In some embodiments, a VEGF aptamer construct may be capable of binding two VEGF monomers simultaneously. In some embodiments, a VEGF aptamer construct binds VEGF with an affinity ($K_d$) of less than 10 nM.

Exemplary PDGF/VEGF Aptamer Constructs

There is considerable evidence that more efficient blocking of tumor-associated and ocular angiogenesis, coupled with new blood vessel regression, is possible with combined inhibition of VEGF and PDGF-B signaling pathways (Bergers, G., et al. (2003) J. Clin. Invest. 111:1287; Jo, N., et al. (2006) Am. J. Pathol. 168:2036). This effect is mediated by the disruption of tight cell-cell association between endothelial cells, which form initial capillary sprouts, and periendothelial cells (or pericytes), which encircle the new blood vessels as they mature, rendering the blood vessels less susceptible to VEGF inhibitors (Benjamin, L. E., et al. (1998) Development 125:1591; Benjamin, L. E., et al. (1999) J. Clin. Invest. 103:159). The aptamers described herein can form the basis of such a dual inhibitor. In some embodiments, a PDGF/VEGF aptamer construct comprises any of the PDGF aptamers described herein linked to any of the VEGF aptamers described herein. In some embodiments, a PDGF/VEGF aptamer construct comprises any of the PDGF aptamers shown in Table 1 linked to any of the VEGF aptamers shown in Table 10 to 14 that have a $K_d$ less than 10 nM. The linkage may be covalent or noncovalent.

The PDGF/VEGF aptamer construct may comprise a PDGF aptamer and a VEGF aptamer in any orientation, such as a PDGF aptamer linked at or near its 3' end to a point at or near the 5' end of a VEGF aptamer, or a VEGF aptamer linked at or near its 3' end to a point at or near the 5' end of a PDGF aptamer, or any other orientation that preserves the binding properties of each aptamer of the construct.

In some embodiments in which the linkage is covalent, the PDGF/VEGF aptamer construct may be linked through a phosphate or phosphorothioate linkage. Many other covalent linkages are also contemplated, such as linkages through various linker moieties, including, but not limited to, hexaethylene glycol linkers, polyethylene glycol linkers, substituted or unsubstituted hydrocarbon linkers, etc. One skilled in the art can select a suitable covalent linkage for linking a PDGF aptamer to a VEGF aptamer.

In some embodiments, the PDGF aptamer and the VEGF aptamer are linked via a noncovalent linkage. Noncovalent linkages include, but are not limited to, biotin/streptavidin; metal-binding peptides/metals; hybridizable modified and/or unmodified oligonucleotides; etc. One of ordinary skill in the art can select a suitable noncovalent linkage for linking a PDGF aptamer to a VEGF aptamer.

Pharmaceutical Compositions Comprising Aptamers and Aptamer Constructs

In some embodiments, pharmaceutical compositions comprising at least one aptamer or aptamer construct described herein and at least one pharmaceutically acceptable carrier are provided. Suitable carriers are described in "Remington: The Science and Practice of Pharmacy, Twenty-first Edition," published by Lippincott Williams & Wilkins, which is incorporated herein by reference. Pharmaceutical compositions that include at least one aptamer or aptamer construct described herein and at least one pharmaceutically acceptable carrier may also include one or more active agents that is not a PDGF or VEGF inhibitor.

The aptamers described herein can be utilized in any pharmaceutically acceptable dosage form, including, but not limited to, injectable dosage forms, liquid dispersions, gels, aerosols, ointments, creams, lyophilized formulations, dry powders, tablets, capsules, controlled release formulations, fast melt formulations, delayed release formulations, extended release formulations, pulsatile release formulations, mixed immediate release and controlled release formulations, etc. Specifically, the aptamers described herein can be formulated: (a) for administration selected from any of oral, pulmonary, intravenous, intra-arterial, intrathecal, intra-articular, rectal, ophthalmic, colonic, parenteral, intracisternal, intravaginal, intraperitoneal, local, buccal, nasal, and topical administration; (b) into a dosage form selected from any of liquid dispersions, gels, aerosols, ointments, creams, tablets, sachets and capsules; (c) into a dosage form selected from any of lyophilized formulations, dry powders, fast melt formulations, controlled release formulations, delayed release formulations, extended release formulations, pulsatile release formulations, and mixed immediate release and controlled release formulations; or (d) any combination thereof.

Solutions or suspensions used for parenteral, intradermal, or subcutaneous application can comprise one or more of the following components: (1) a sterile diluent such as water for injection, saline solution, fixed oils, polyethylene glycols, glycerine, propylene glycol or other synthetic solvents; (2) antibacterial agents such as benzyl alcohol or methyl parabens; (3) antioxidants such as ascorbic acid or sodium bisulfite; (4) chelating agents such as ethylenediaminetetraacetic acid; (5) buffers such as acetates, citrates or phosphates; and (5) agents for the adjustment of tonicity such as sodium chloride or dextrose. The pH can be adjusted with acids or bases, such as hydrochloric acid or sodium hydroxide. A parenteral preparation can be enclosed in ampoules, disposable syringes or multiple dose vials made of glass or plastic.

Pharmaceutical compositions suitable for injectable use may include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL (BASF, Parsippany, N.J.) or phosphate buffered saline (PBS). In all cases, the composition should be sterile and should be fluid to the extent that easy syringability exists. The pharmaceutical composition should be stable under the conditions of manufacture and storage and should be preserved against the contaminating action of microorganisms such as bacteria and fungi. The term "stable", as used herein, means remaining in a state or condition that is suitable for administration to a subject.

The carrier can be a solvent or dispersion medium, including, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion, and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as mannitol or sorbitol, and inorganic salts such as sodium chloride, in the composition. Prolonged absorption of the injectable compositions can be brought about by including in the composition an agent which delays absorption, for example, aluminum monostearate and gelatin.

Sterile injectable solutions can be prepared by incorporating the active reagent (e.g., an aptamer, and/or an aptamer construct) in an appropriate amount in an appropriate solvent with one or a combination of ingredients enumerated above, as desired, followed by filtered sterilization. Generally, dispersions are prepared by incorporating at least one aptamer, and/or aptamer construct into a sterile vehicle that contains a basic dispersion medium and any other desired ingredient. In the case of sterile powders for the preparation of sterile injectable solutions, exemplary methods of preparation include vacuum drying and freeze-drying, both of which will yield a powder of an aptamer, and/or an aptamer construct plus any additional desired ingredient from a previously sterile-filtered solution thereof.

In some embodiments, an aptamer, and/or an aptamer construct is formulated for intravitreal injection. Suitable formulations for intravitreal administration are described, e.g., in. Ocular drug delivery is discussed, e.g., in Rawas-Qalaji et al. (2012) Curr. Eye Res. 37: 345; Bochot et al. (2012) J. Control Release 161:628; Yasukawa et al. (2011) Recent Pat. Drug Deliv. Formul. 5:1; and Doshi et al. (2011) Semin. Ophthalmol. 26:104. In some embodiments, a pharmaceutical composition comprising an aptamer, and/or an aptamer construct is administered by intravitreal injection once per week, once per two weeks, once per three weeks, once per four weeks, once per five weeks, once per six weeks, once per seven weeks, once per eight weeks, once per nine weeks, once per 10 weeks, once per 11 weeks, once per 12 weeks, or less often than once per 12 weeks.

Oral compositions generally include an inert diluent or an edible carrier. They can be enclosed, for example, in gelatin capsules or compressed into tablets. For the purpose of oral therapeutic administration, the aptamer, and/or aptamer construct can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition.

For administration by inhalation, the compounds are delivered in the form of an aerosol spray from a pressured container or dispenser that contains a suitable propellant, e.g., a gas such as carbon dioxide, a nebulized liquid, or a dry powder from a suitable device. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active reagents are formulated into ointments, salves, gels, or creams, as generally known in the art. The reagents can also be prepared in the form of suppositories (e.g., with conventional suppository bases such as cocoa butter and other glycerides) or retention enemas for rectal delivery.

In some embodiments, an aptamer, and/or an aptamer construct is prepared with a carrier that will protect against rapid elimination from the body. For example, a controlled release formulation can be used, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc.

Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

Additionally, suspensions of an aptamer, and/or an aptamer construct may be prepared as appropriate oily injection suspensions. Suitable lipophilic solvents or vehicles include fatty oils, such as sesame oil, or synthetic fatty acid esters, such as ethyl oleate, triglycerides, or liposomes. Non-lipid polycationic amino polymers may also be used for delivery. Optionally, the suspension may also include suitable stabilizers or agents to increase the solubility of the compounds and allow for the preparation of highly concentrated solutions.

In some cases, it may be especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of an aptamer and/or aptamer construct calculated to produce the desired therapeutic effect in association with the required pharmaceutical carrier. The specification for the dosage unit forms of aptamers and/or constructs described herein are dictated by and directly dependent on the characteristics of the particular aptamer and/or aptamer construct and the particular therapeutic effect to be achieved, and the limitations inherent in the art of compounding such an active agent for the treatment of individuals.

Pharmaceutical compositions comprising at least one aptamer, and/or aptamer construct can include one or more pharmaceutical excipients. Examples of such excipients include, but are not limited to, binding agents, filling agents, lubricating agents, suspending agents, sweeteners, flavoring agents, preservatives, buffers, wetting agents, disintegrants, effervescent agents, and other excipients. Such excipients are known in the art. Exemplary excipients include: (1) binding agents which include various celluloses and cross-linked polyvinylpyrrolidone, microcrystalline cellulose, such as Avicel® PH101 and Avicel® PH102, silicified microcrystalline cellulose (ProSolv SMCC™), gum tragacanth and gelatin; (2) filling agents such as various starches, lactose, lactose monohydrate, and lactose anhydrous; (3) disintegrating agents such as alginic acid, Primogel, corn starch, lightly crosslinked polyvinyl pyrrolidone, potato starch, maize starch, and modified starches, croscarmellose sodium, cross-povidone, sodium starch glycolate, and mixtures thereof; (4) lubricants, including agents that act on the flowability of a powder to be compressed, and including magnesium stearate, colloidal silicon dioxide, such as Aerosil® 200, talc, stearic acid, calcium stearate, and silica gel; (5) glidants such as colloidal silicon dioxide; (6) preservatives, such as potassium sorbate, methylparaben, propylparaben, benzoic acid and its salts, other esters of parahydroxybenzoic acid such as butylparaben, alcohols such as ethyl or benzyl alcohol, phenolic compounds such as phenol, or quaternary compounds such as benzalkonium chloride; (7) diluents such as pharmaceutically acceptable inert fillers, such as microcrystalline cellulose, lactose, dibasic calcium phosphate, saccharides, and/or mixtures of any of the foregoing; examples of diluents include microcrystalline cellulose, such as Avicel® PH101 and Avicel® PH102; lactose such as lactose monohydrate, lactose anhydrous, and Pharmatose® DCL21; dibasic calcium phosphate such as Emcompress®; mannitol; starch; sorbitol; sucrose; and glucose; (8) sweetening agents, including any natural or artificial sweetener, such as sucrose, saccharin sucrose, xylitol, sodium saccharin, cyclamate, aspartame, and acesulfame; (9) flavoring agents, such as peppermint, methyl salicylate, orange flavoring, Magnasweet® (trademark of MAFCO), bubble gum flavor, fruit flavors, and the like; and (10) effervescent agents, including effervescent couples such as an organic acid and a carbonate or bicarbonate. Suitable organic acids include, for example, citric, tartaric, malic, fumaric, adipic, succinic, and alginic acids and anhydrides and acid salts.

Suitable carbonates and bicarbonates include, for example, sodium carbonate, sodium bicarbonate, potassium carbonate, potassium bicarbonate, magnesium carbonate, sodium glycine carbonate, L-lysine carbonate, and arginine carbonate. Alternatively, only the sodium bicarbonate component of the effervescent couple may be present.

In various embodiments, the formulations described herein are substantially pure. As used herein, "substantially pure" means the active ingredient (e.g., an aptamer, and/or an aptamer construct) is the predominant species present (i.e., on a molar basis it is more abundant than any other individual species in the composition). In some embodiments, a substantially purified fraction is a composition wherein the active ingredient comprises at least about 50 percent (on a molar basis) of all macromolecular species present. Generally, a substantially pure composition will include more than about 80% of all macromolecular species present in the composition. In various embodiments, a substantially pure composition will include at least about 85%, at least about 90%, at least about 95%, or at least about 99% of all macromolecular species present in the composition. In various embodiments, the active ingredient is purified to homogeneity (contaminant species cannot be detected in the composition by conventional detection methods) wherein the composition consists essentially of a single macromolecular species.

Kits Comprising Aptamers and Aptamer Constructs

The present disclosure provides kits comprising any of the aptamers, and/or aptamer constructs described herein. Such kits can comprise, for example, (1) at least one aptamer, and/or aptamer constructs; and (2) at least one pharmaceutically acceptable carrier, such as a solvent or solution. Additional kit components can optionally include, for example: (1) any of the pharmaceutically acceptable excipients identified herein, such as stabilizers, buffers, etc., (2) at least one container, vial or similar apparatus for holding and/or mixing the kit components; and (3) delivery apparatus.

Methods of Treatment

The present disclosure provides methods of preventing or treating (e.g., alleviating one or more symptoms of) medical conditions through the use of a PDGF aptamer or aptamer construct, a VEGF aptamer or aptamer construct, and/or a VEGF/PDGF aptamer construct. The methods comprise administering a therapeutically effective amount of such aptamers and/or aptamer constructs to a subject in need thereof. The described aptamers can also be used for prophylactic therapy. In some embodiments, the aptamer and/or aptamer construct is administered orally or intravenously.

The aptamer and/or aptamer construct used in methods of treatment can be: a PDGF aptamer or aptamer construct a VEGF aptamer or aptamer construct, and/or a VEGF/PDGF aptamer construct described herein, or a pharmaceutically acceptable salt thereof, or a prodrug thereof.

The individual or subject can be any animal (domestic, livestock or wild), including, but not limited to, cats, dogs, horses, pigs and cattle, and preferably humans. As used herein, the terms patient, individual, and subject may be used interchangeably.

As used herein, "treating" describes the management and care of a patient for the purpose of treating a disease, condition, or disorder and includes the administration of an aptamer, and/or an aptamer construct to prevent the onset of the symptoms or complications of a disease, condition or disorder; to alleviate symptoms or complications of the disease, condition, or disorder; or to eliminate the presence of the disease, condition or disorder in the patient. More specifically, "treating" includes reversing, attenuating, alleviating, minimizing, suppressing or halting at least one deleterious symptom or effect of a disease (disorder) state, disease progression, disease causative agent or other abnormal condition. Treatment is generally continued as long as symptoms and/or pathology ameliorate.

As used herein, "preventing" means preventing in whole or in part; ameliorating or controlling; reducing, lessening, or decreasing; or retarding or halting.

In various embodiments, the disclosed compositions and methods are used to treat cardiovascular diseases, cancers, fibrosis, renal diseases or ophthalmic diseases.

In some embodiments, the disclosed compounds or pharmaceutically acceptable salts thereof, or prodrugs, can be administered in combination with other treatments that improve or eradicate the disease conditions as described above. Compositions including the disclosed aptamers and/or aptamer constructs may contain, for example, more than one aptamer. In some examples, a composition containing one or more aptamers is administered in combination with another useful cardiovascular agent or anticancer agent or antifibrotic agent etc. In general, the currently available dosage forms of the known therapeutic agents for use in such combinations will be suitable.

"Combination therapy" (or "co-therapy") includes the administration of an aptamer and/or aptamer construct composition and at least one second agent as part of a specific treatment regimen intended to provide the beneficial effect from the co-action of these therapeutic agents. The beneficial effect of the combination includes, but is not limited to, pharmacokinetic or pharmacodynamic co-action resulting from the combination of therapeutic agents. Administration of these therapeutic agents in combination typically is carried out over a defined time period (usually minutes, hours, days or weeks depending upon the combination selected).

"Combination therapy" may, but generally is not, intended to encompass the administration of two or more of these therapeutic agents as part of separate monotherapy regimens that incidentally and arbitrarily result in the combinations of the present disclosure. "Combination therapy" is intended to embrace administration of these therapeutic agents in a sequential manner, that is, wherein each therapeutic agent is administered at a different time, as well as administration of these therapeutic agents, or at least two of the therapeutic agents, in a substantially simultaneous manner. Substantially simultaneous administration can be accomplished, for example, by administering to the subject a single dose having a fixed ratio of each therapeutic agent or in multiple, single doses for each of the therapeutic agents.

The dosage regimen utilizing the aptamers and/or aptamer constructs is selected in accordance with a variety of factors, including, for example, type, species, age, weight, gender and medical condition of the subject; the severity of the condition to be treated; the route of administration; the renal and hepatic function of the subject; and the particular aptamer and/or aptamer constructs or salts thereof employed. An ordinarily skilled physician or veterinarian can readily determine and prescribe the effective amount of the composition required to prevent, counter or arrest the progress of the condition.

In general, the dosage, i.e., the therapeutically effective amount, ranges from about 1 µg to about 100 mg/kg body weight of the subject being treated, per day.

EXAMPLES

The following examples are provided for illustrative purposes only and are not intended to limit the scope of the invention as defined by the appended claims. All examples described herein were carried out using standard techniques, which are well known and routine to those of skill in the art. Routine molecular biology techniques described in the following examples can be carried out as described in standard laboratory manuals, such as Sambrook et al. (2001) Molecular Cloning: A Laboratory Manual, 3rd. ed., Cold Spring Harbor Laboratory Press, Cold Spring Harbor, N.Y.).

Example 1. PDGF Aptamer Selection and Sequences

Preparation of Candidate Mixtures:

A candidate mixture of partially randomized ssDNA oligonucleotides was prepared by polymerase extension of a DNA primer annealed to a biotinylated ssDNA template.

SELEX Conditions:

Aptamers to the PDGF-BB protein (R&D Systems) were selected by SomaLogic Inc, as described (Gold et al. (2010) PLoS One 5:e15004), from a library containing a 40-nucleotide random region in which Bn-dU was substituted for dT. The forward primer was 5'-CGCCCTCGTCCCATCTC (SEQ ID NO: 837), and the reverse primer was 5'-CGTTCTCGGTTGGTGTTC (SEQ ID NO: 838). The PDGF-BB protein was biotinylated and partitioned on streptavidin MyOne-SA (Dynal) beads. Preferential selection of aptamers with slow dissociation rates was achieved using a kinetic challenge wherein protein-DNA complexes were incubated in the presence of 10 mM dextran sulfate at 37° C. with increased incubation times and decreased protein concentrations in successive rounds. Kinetic challenge was initiated in round 4 of the selection and was continued through the final $8^{th}$ round with incubation times as follows: 5 minutes round 4, 15 minutes rounds 5-7, 30 minutes round 8.

Pool Sequencing:

Oligonucleotide sequences from the $8^{th}$ round pool were cloned and several clones were sequenced. This led to the identification of a family of related sequences, as exemplified by the 4149-8_1.

Deep Sequencing of PDGF SELEX Pool:

To evaluate more completely the sequences within the 4149-8_1 aptamer family, the $8^{th}$ round pool was sequenced using 454 pyrosequencing technology. The pool DNA was amplified with 454 primers and the PCR product was purified and normalized using a Sequal normalization plate (Invitrogen, Cat#A10510-01). The eluate was run on a gel to confirm the size and purity of each amplicon. The purified PCR product was sequenced at the 454 pyrosequencing facility at the University of Colorado Health Science Center in Aurora Colo.

The 454 sequences were aligned with 4149-8_1 by CLUSTAL analysis. The sequence data set from the pool contained 10,803 full length sequences (i.e., those sequences containing both primer sequences) of which 3,839 were unique. These 3,839 unique sequences were searched for the motif "5'-ZACNCGCGZZZAZAGCG" (identity=0.65) (SEQ ID NO: 839) and then "ZZ" (identity=1.0) upstream from this. There were 436 sequences found that contained both of these motifs. In addition, 58 other sequences contained only the first pattern but with a generally low identity and with no evident hairpin structure upstream. The 436 sequences were then aligned as follows, (1) with respect to "ZZ", (2) with respect to the center of the loop, and (3) with respect to "ZACNCGCGZZZAZAGCG" (SEQ ID NO: 839). For all the sequences, the percentage identity at each position with 4149-8_1 was calculated as listed in FIG. 3A. Tables 1 and 2 lists a number of sequences representative of the 4149-8_1 aptamer family of sequences.

Aptamer Synthesis:

The modified deoxyuridine-5-carboxamide amidite reagents used for solid-phase synthesis were prepared by: condensation of 5'-O-(4,4'-dimethoxytrityl)-5-trifluoroethoxycarbonyl-2'-deoxyuridine (Nomura et al. (1997) Nucl. Acids Res. 25:2784) with the appropriate primary amine ($RNH_2$, 1.2 eq; $Et_3N$, 3 eq.; acetonitrile; 60° C.; 4 h); 3'-O-phophitidylation with 2-cyanoethyl-N,N-diisopropylchlorophosphoramidite (1.2 eq.; $iPr_2EtN$, 3 eq.; $CH_2Cl_2$; −10 to 0° C.; 4 h); and purification by flash chromatography on neutral silica gel (Still, et al. (1978) J. Org. Chem. 43:2923). Aptamers were prepared by solid phase synthesis using the phosphoramidite method (Beaucage and Caruthers (1981) Tetrahedron Lett. 22:1859) with some adjustments to the protocol to account for the unique base modifications described herein. Detritylation was accomplished with 10% dichloroacetic acid in toluene for 45 seconds; coupling was achieved with 0.1 M phosphoramidites in 1:1 acetonitrile: dichloromethane activated by 5-benzylmercaptotetrazole and allowed to react 3 times for 5 minutes; capping and oxidation were performed according to instrument vendor recommendations. Deprotection was effected with 1:1:2, t-butylamine:methanol:water (Mullah 1998), reacted for 24 hours at 37 degrees centigrade. Aptamers were synthesized at 200 nmol scale and purified from a polyacrylamide gel using UV shadowing as described (Fitzwater and Polisky (1996) Methods Enzymol. 267:275) with Costar Spin-X (not including siliconized glass wool or spun polypropylene prefilter) and Amicon YM3 concentration per manufacturer's recommendations.

Modified Nucleotide Structure Activity Relationship and Affinity Maturation:

To examine the contribution of each of the eight benzyl side chains to binding, we performed another series of systematic point substitutions by chemically synthesizing 5-position variants with a custom-made library of modified dU phosphoramidites. For this purpose, we designed a library to allow us to probe the microenvironment of each of the positions by varying the size, polarity, disposition of H-bond donors and acceptors, linker length, and orientation of the 5-position substituents. In choosing the functional groups for this analysis, we aimed to include variations on a theme of the original modification (in this case, the benzyl group), amino acid side chains overrepresented in complementarity determining regions (CDRs) of antibodies (like tryptophan and tyrosine) (Mian, I S, et al. (1991) J. Mol. Biol. 217:133; Ramaraj T. et al. (2012) Biochim. Biophys. Acta. 1824:520), and "privileged" fragments of small-molecule drugs (Welsch et al. (2010) Curr. Opin. Chem. Biol. 14:347). In a sense, we endeavored to combine elements of affinity maturation in antibodies and structure-activity relationship (SAR) optimization in medicinal chemistry. Although we utilized a single modified nucleotide during SELEX, post-SELEX optimization is constrained only by the synthetic accessibility of the modified monomers and compatibility with solid-phase synthesis.

Figure 6B:
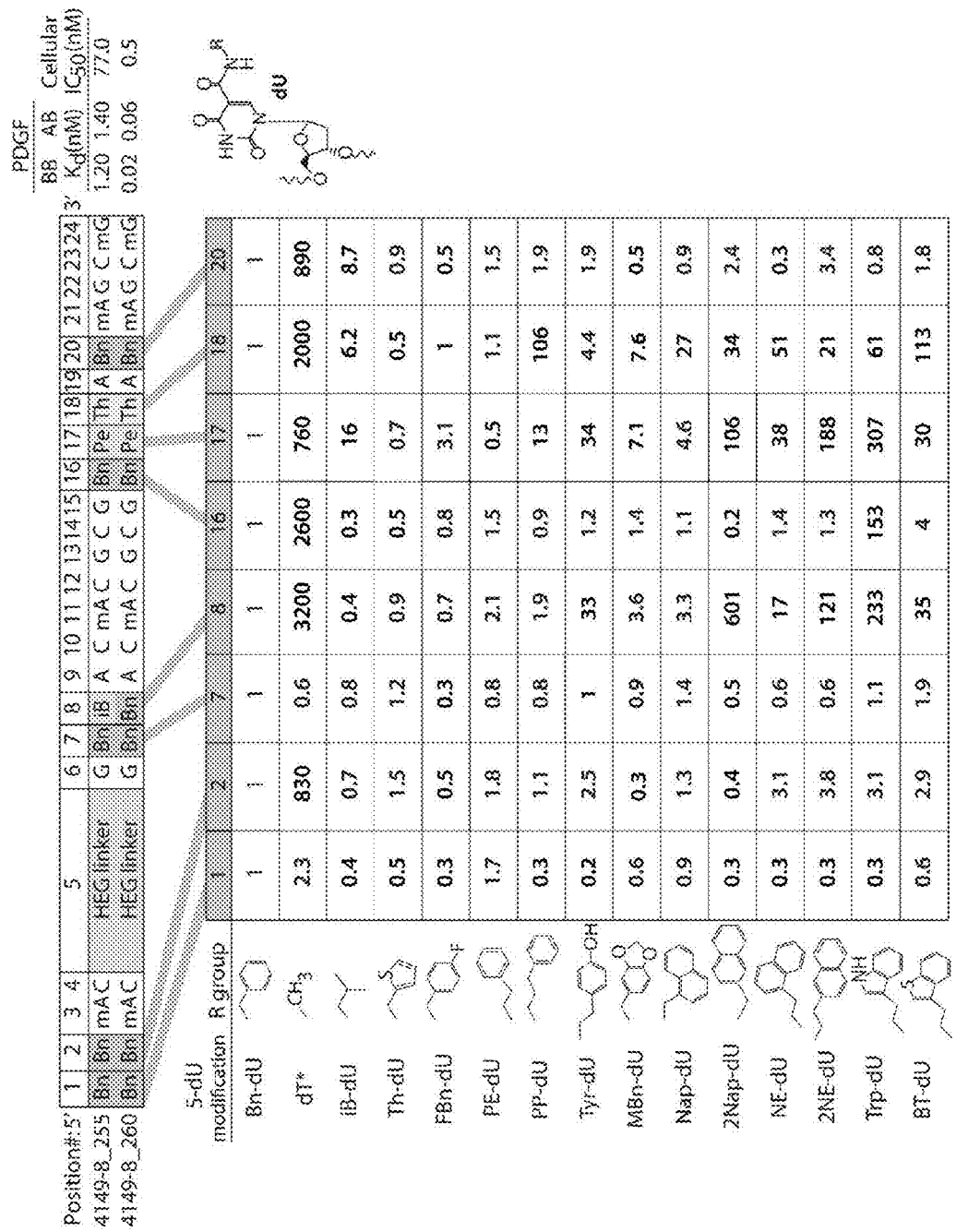
FIG. 6B shows $K_d$ ratios for modified aptamers based on parent aptamer 4149-8_130 (SEQ ID NO: 130), in which a particular Bn-dU nucleobase has been replaced by another modified dU nucleobase, relative to the parent aptamer (numbers <1 indicate the modified aptamer has greater affinity than the parent aptamer, and numbers >1 indicate the modified aptamer has lower affinity than the parent aptamer); as described in Example 1.

The effect of individual substitutions of the benzyl group with fourteen alternative moieties at the 5-position is summarized in FIGS. 1C and D, and FIG. 6B, with relative affinities expressed as dissociation constant ratios and relative PDGF Rβ phosphorylation expressed as percent phospho-PDGF Rβ ratios. Substitution with dT, which only has a methyl group at the 5-position, represents the most drastic change, and in that sense is comparable to alanine scanning mutagenesis in proteins (Cunningham, B. C. et al. (1989) Science 243:1330). Not surprisingly, this was the least tolerated substitution at six of the eight modified nucleotide positions. The exceptions were nucleotides 1 and 7, where this substitution was well-tolerated. These two positions also tolerated many other substitutions, with some replacements yielding up to 5-fold improvement in binding affinity (FIG. 6B). In contrast, nucleotides 8, 17 and 18 exhibited the highest sensitivity to changes. The best single substitutions were then combined, yielding additional variants including 4149-8_255 and 4149-8_260 (FIG. 6B). Aptamer 4149-8_260, which combined phenethyl-dU (Pe-dU) at nucleotide 17 and thiophene-dU (Th-dU) at nucleotide 18, showed excellent binding to both PDGF-BB and PDGF-AB (FIG. 6B). It is worth noting that the affinity of the originally selected SOMAmer was already so high ($K_d$=20 pM) that it approached the detection limit of the binding assay, so it is possible that the degree of affinity improvement is underestimated. We have applied similar post-SELEX optimization strategies to other SOMAmers with weaker initial binding (e.g., $K_d$ values ranging from 100 pM to >10 nM), and have observed affinity improvements of up to 100-fold.

Homodimers of PDGF Aptamer 4149-8_260 (SL5):

Since PDGF forms a covalently linked homodimer, and two SOMAmers bind to each PDGF homodimer, we determined the effect on binding of homodimerized SOMAmers. The affinity of the PDGF aptamer homodimers could be substantially improved compared to the affinity of the corresponding monomers, due to avidity effects. The crystal structure showed that the 5' ends of the SOMAmer were 38 Å apart, while the 3' ends were 74 Å apart. Connecting the 5' to 3' end would require at least 63 Å since the shortest path between the two points bisected the protein. Two types of homodimers were ordered, based on readily available chemistry. These were 1) head-to-tail homodimers connected by two to six Heg linkers, which provide ~20 Å distance per Heg, and 2) 3'-3' homodimers connected via a synthetic doubler support, combined with one to three Hegs. The homodimers of 4149-8_260 were tested in the PDGF-BB Zorbax binding assay. The binding assay was performed with limiting amount of SOMAmer, and would not distinguish binding of one SOMAmer per protein dimer versus binding of two SOMAmers per protein dimer. The structure of the homodimers is shown in Table 1 (sequences 4149-8_334 through 4149-8_342). The $K_d$ values obtained in the Zorbax assay suggested that in the 5' to 3' configuration, a longer linker was desirable, and gave up to 10-fold improvement in binding affinity, as shown in Table 1a. In the 3'-3' linked homodimers, the shorter linker actually appeared to perform better than the longer linker. This was corroborated by cellular phosphorylation results, see Table 1a.

Based on these sequences, an exemplary consensus sequence is:

(SEQ ID NO: 502)
5'-ZZVCL$_n$GV'ZACNMGCGZZZAZAGCG-3', wherein
V is selected from an A, C or G;
V' is selected from a C, G or Z, wherein V' is complementary to V;
N is independently selected from any naturally occurring or modified nucleotide;
M is selected from a C or A;
Z is independently selected from a modified pyrimidine; L is a spacer selected from any naturally occurring or modified nucleotide, a hydrocarbon linker, a polyethylene glycol linker or a combination thereof; and
n is 0 to 20;
wherein one or more nucleotide insertions are optionally included.

Sequence Truncation Studies:

Systematic truncation from the 5' and 3' ends of 4149-8_1 was performed to define a minimum length required to retain full binding activity of the aptamer to human PDGF-BB, as shown in Table 3. $K_d$ values for a subset of the truncations are shown. Z=Benzyl-deoxyuridine (Bn-dU); A, C, G and T are deoxyribonucleotides.

Protein Expression and Purification, and Aptamer Complex Formation

For crystallography studies, recombinant human PDGF-BB protein was purchased from Creative BioMart (Shirley, N.Y.). The recombinant protein was expressed in E. coli cells. Aptamer solutions were thawed and then annealed by heating to ~95° C. for 5 minutes, then incubating at 40° C. for 5 minutes, then cooling to room temperature. The annealed aptamer solution was mixed with protein at a 1.1:1 ratio of DNA to protein. The complex was diluted 5-fold in buffer containing 20 mM Na/K phosphate (pH 7) and 100 mM NaCl. The resulting mixture was concentrated to ~4 mg/mL in protein in a 1.5 mL Amicon centrifugal filter. Final concentration was estimated from the final volume of retentate.

Example 2. Crystallization and Structure of PDGF-Aptamer Complex

Crystals were grown using the sitting drop vapor diffusion method in Compact, Jr. plates (Emerald BioSystems, WA)

set up at 16° C. Crystals for data collection were obtained from a primary screen (ProPlex, Molecular Dimensions). The crystal for the PDGF-BB:4149-8_255 complex was grown from 100 mM magnesium acetate, 100 mM sodium acetate (pH 4.5) and 8% (w/v) PEG 8000. The crystal for the PDGF-BB:4149-8_260 complex was grown from 100 mM magnesium acetate, 100 mM sodium cacodylate (pH 6.5) and 15% (w/v) PEG 6000. Crystals were harvested with Litho Loops and cryoprotected by quick transfer to reservoir solution containing 33% (v/v) ethylene glycol before flash-cooling by plunging directly into liquid nitrogen.

Data Collection and Structure Determination:

Data for both structures were collected at beamline 19-ID of the Advanced Photon Source (Argonne, Ill.). The data sets were processed using XDS (Kabsch 2010). The structure of the PDGF-BB:4149-8_260 complex was initially phased by molecular replacement using Phaser from the CCP4 software suite (CCP4, 1994) with the protein model of PDGF from the structure of the PDGF-BB:Beta-type PDGF receptor complex (PDB entry 3MJG) as the search model. Molecular replacement located a single protein monomer per asymmetric unit. Inspection of the electron density maps following an initial round of restrained refinement in REF-MAC showed features consistent with nucleic acid adjacent to the protein model. The model of the aptamer was subsequently built through a process of "bootstrapping", i.e., partial models were subjected to iterative rounds of refinement; resulting in marginally improved maps which allowed further model building. First, phosphate ions were built in nucleic acid backbone density. Secondly, phosphates were replaced by dT residues. Following refinement, modified residues could be discerned by protrusions of positive difference electron density. Identification of the modified residues facilitated determination of the sequence register of the aptamer, and in the final steps dT residues were replaced with the correct nucleobases. All manual building was performed using the Crystallographic Object-Oriented Toolkit (Coot) (Emsley & Cowtan, 2004). The structure of the PDGF-BB:4149-8_255 structure was solved by molecular replacement using the finished model of the 4149-8_260 complex.

In each structure, a protuberance of electron density was observed contiguous with the electron density of the Oγ atom of residues Thr88 and Thr90. Although O-mannosylation has been reported at these sites for recombinant PDGF-B expressed in yeast (Settineri, et al., (1990)) there is little reason to expect similar post-translational modifications in the PDGF-B expressed in E. coli. As the observed electron density suggested less than full occupancy, the threonine residues were modeled without any post-translational modification.

Table 4 discloses data-collection statistics and refinement and model statistics of two aptamer ligands with 4149-8_260 (SEQ ID. NO. 211) and 4149-8_255 (SEQ ID. NO. 207) respectively.

Table 5 illustrates base-pair parameters for the PDGF BB aptamer compared to B-form DNA. The PDGF BB aptamer adopts deviated B-form conformations in the 5' stem loop domain and in both stems of the miniknot. Where appropriate, mean values and standard deviations (in parenthesis) are given. Aptamer values are based on analysis using web3DNA (Zheng et al. (2009) Nucleic. Acids Res. 37:W240) and B-DNA values (as found in high resolution crystal structures) were determined using 3DNA as described and reported in Olson, et al. (2001) J. Mol. Biol. 313(1): 229.

Figures 2B, 2C:
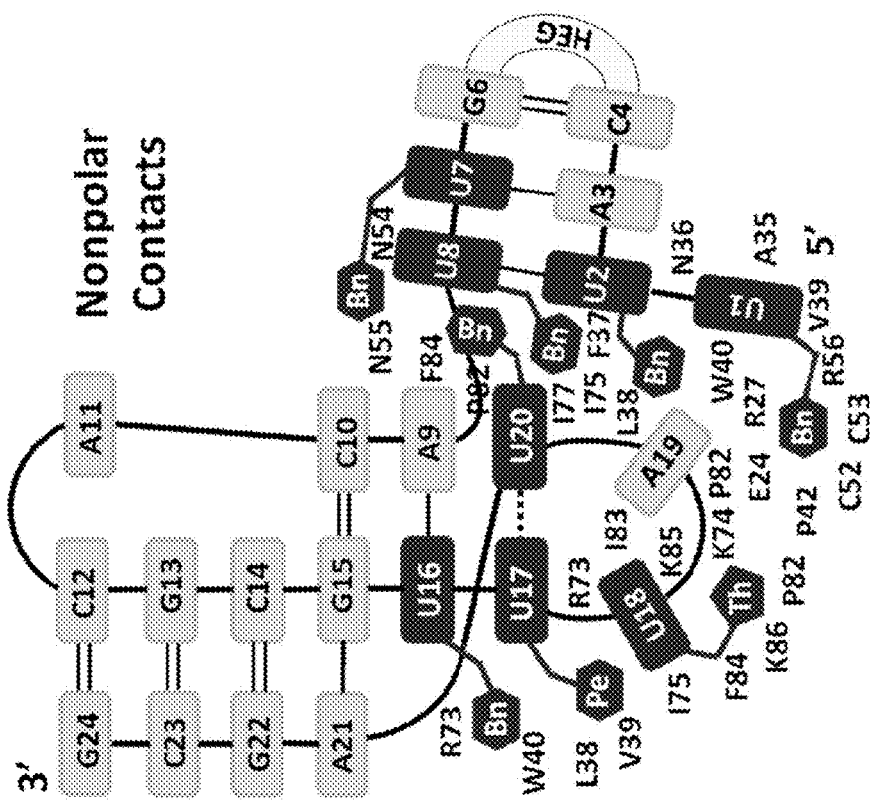
FIG. 2B shows a representation of nonpolar intramolecular and aptamer-PDGF contacts.
FIG. 2C shows a representation of polar intramolecular and aptamer-PDGF contacts; as described in Example 2. Hydrophobic (nonpolar) interactions include π-π interactions (both face-to-face and edge-to-face aromatic interactions) and van der Waals contact (vW). Polar interactions include hydrogen bonds (dashed lines) and charge-charge interactions (solid lines). Certain aptamer residues (e.g., dC4, dG6, dA9, dC10, dC12, dG13, dC14, dG15, dG22, dC23 and 2'-O-methyl G24) participate in canonical base pairing and base stacking, as shown in B and C, and 2'-O-methyl A11 is extruded.
Figure 7A:
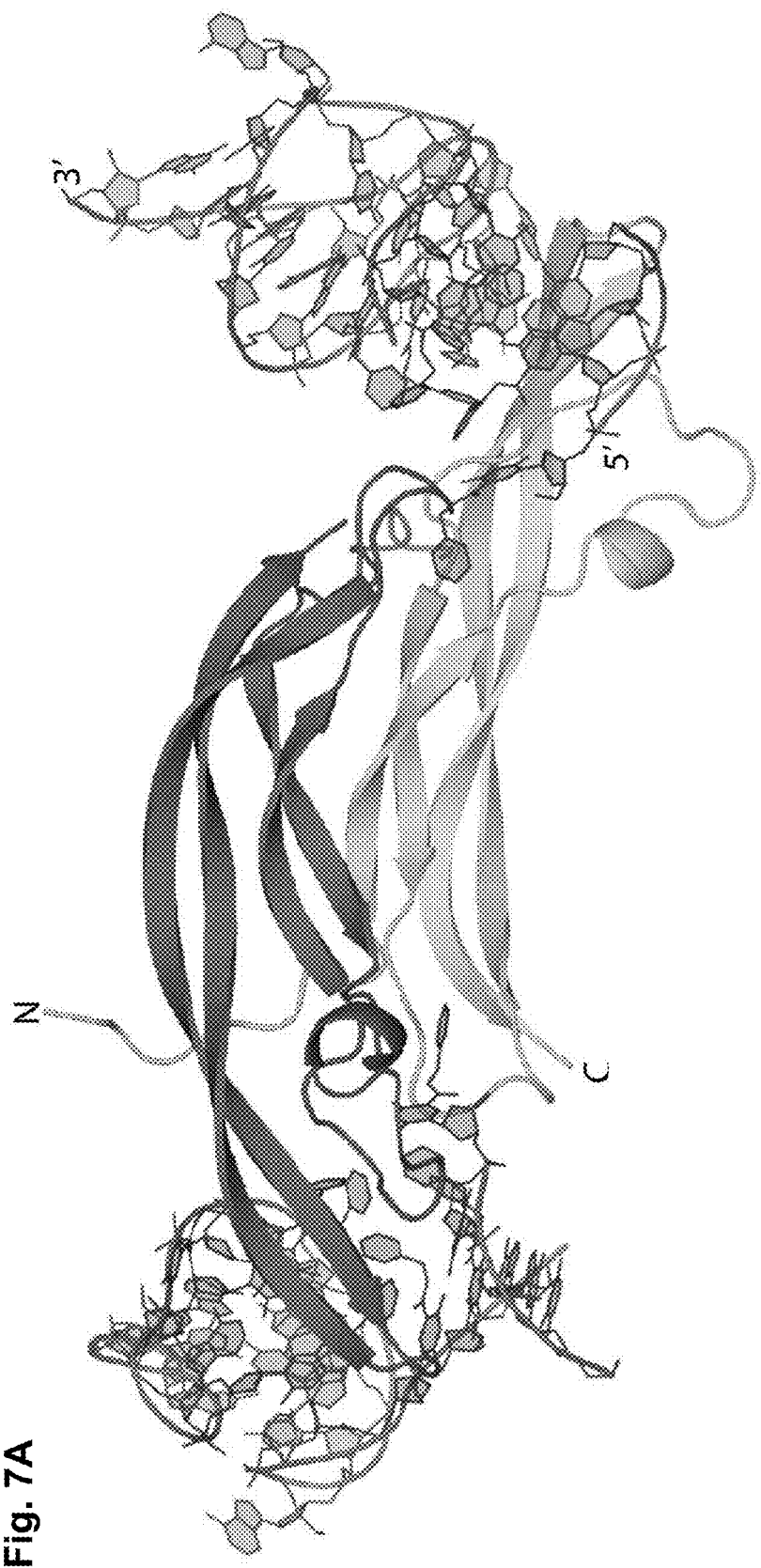
FIG. 7A shows a ribbon diagram of the PDGF-BB homodimer bound to aptamer 4149-8_260 (SEQ ID NO: 211)

The monomeric subunits of PDGF-BB form twisted β-sheets that dimerize in an anti-parallel orientation characteristic of the cystine knot family of proteins (Oefner et al. (1992) EMBO J. 11:3921). SL5 (4149-8_260) binds two homologous sites at either end of the long axis, crossing the homodimer interface and contacting each of the three PDGF loops (FIG. 7A). The SOMAmer is composed of two domains connected by a network of hydrophobic aromatic interactions (FIG. 7B). At the 5' end, a short stem is capped with a Heg loop (disordered in the crystal structure), while the remainder of the molecule folds into an extraordinarily small H-type pseudoknot (Aalberts, D. P. et al. (2005) Nucleic Acids Res. 33:2210), with modified nucleotides clustering at the stem loop/pseudoknot junction. Remarkably, all eight modified nucleotides are in contact with PDGF. Seven modified nucleotides cluster together along a hydrophobic groove on the protein, while Bn-dU1 adopts an extended conformation, following a channel at the PDGF homodimer interface. Two natural nucleotides also contact PDGF, with the remaining natural nucleotides contributing to internal structure (FIG. 2 and FIG. 7). The secondary structure elements of SL5, a stem-loop and a pseudoknot, are well-known nucleic acid structural motifs. However, replacement of certain conventional bases with modified nucleotides offers novel functional groups for alternative interactions. This distinguishing feature of SL5 results in an extensive hydrophobic surface for protein binding as well as unique intramolecular contacts between canonical and modified nucleotides.

Although the 3' end of SL5 exhibits hallmark characteristics of an H-type pseudoknot (Staple, D. W. et al. (2005) PLoS Biol. 3:e213), this categorization understates the unconventional nature of this signature "miniknot" motif. Compared to the smallest structurally reported H-type pseudoknot which requires 21 nucleotides (Nonin-Lecomte S. et al. (2006) Nucleic Acids Res. 34:1847), the SL5 miniknot consists of a mere 16 nucleotides (FIG. 7B). Furthermore, deletion of the terminal mG24:dC12 base pair of stem 2 (S2) results in undiminished binding affinity (FIG. 3), demonstrating the functional integrity of a 14-nucleotide miniknot. With unprecedented backbone twists and stacking interactions, the miniknot represents a novel pseudoknot variant in which unusually small size is attained via stabilization contributed by packing of the hydrophobic moieties of the modified nucleotides.

Figure 8C:
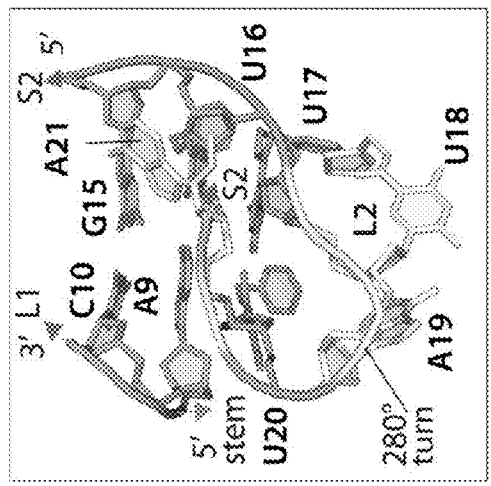
FIGS. 8A-8L illustrate certain structural features of the PDGF aptamer from the crystal structure of the PDGF-BB: 4149-8_260 aptamer complex, as described in Example 2.
Figure 8B:
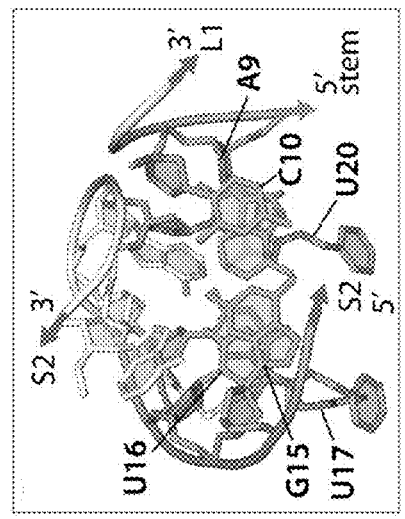
Figure 8F:
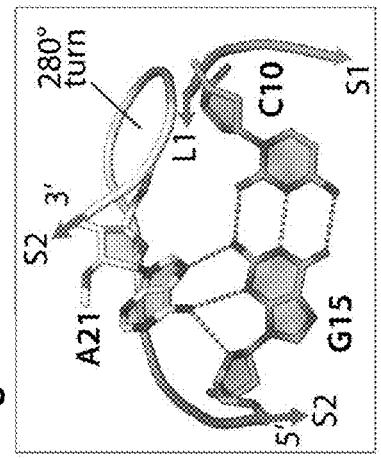
Figure 8E:
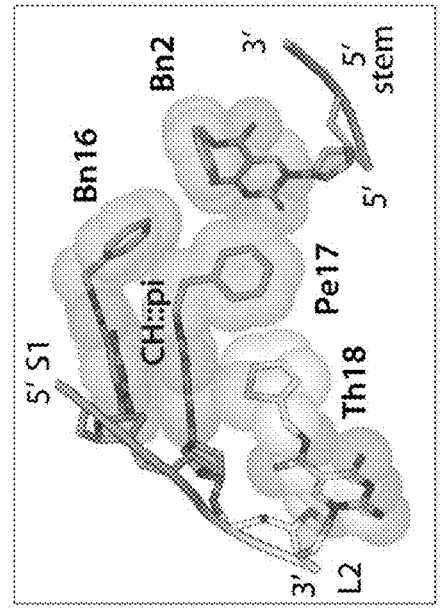
Figure 8A:
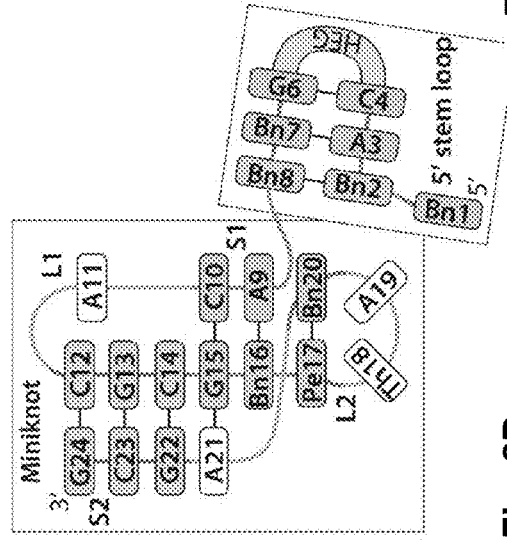
Figure 8D:
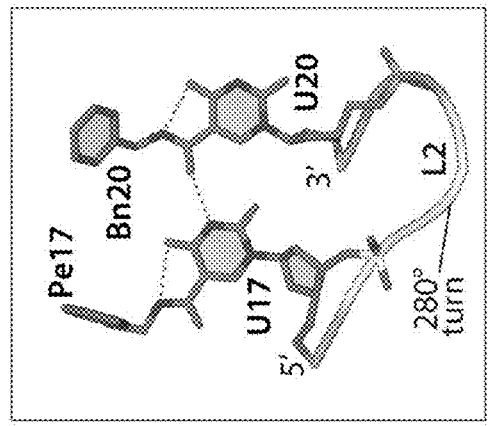

Miniknot stem 1 (S1) formally consists of just two Watson-Crick base pairs (FIG. 8A), while loop 2 (L2) is composed nominally of 5 bases, Pe-dU17, Th-dU18, dA19, Bn-dU20 and mA21. While interactions between L2 and S1 are a defining feature of pseudoknots, they are typically limited to H-bonding. In contrast, the SOMAmer miniknot makes atypical loop-to-stem stacking interactions, supported by unconventional base pairing. In particular, S1 is stabilized by stacking with a non-canonical Bn-dU17:Bn-dU20 base pair derived from L2 (FIG. 8C and FIG. 8B), effectively creating a three base-pair S1 with a novel backbone discontinuity. In contrast to previously described U:U imino carbonyl base pairs, the Pe-dU17:Bn-dU20 base pair utilizes a single H-bond between N3 of Bn-dU17 and the carbonyl oxygen in the amide linker of Bn-dU20 (FIG. 8D). The syn conformation about the glycosyl bond of Bn-dU20 impedes H-bonding with Bn-dU17, but allows Bn20 to stack with Bn-dU8 base without steric clashing with the sugar of Bn-dU8. The unconventional Pe-dU17:Bn-dU20 base pair is made possible by a 280° turn in the backbone between nucleotides 18 and 20 (FIG. 8C). This dramatic strand reversal allows Bn-dU20 base to stack with the sugar of dA9 and form a hydrogen bond with Pe-dU17. Importantly, the Pe-dU17:Bn-dU20 base pair derives additional stabilization through hydrophobic interactions conferred by the modified nucleotides; the ethylene (linker) portion of the Pe-dU17 side chain is directed toward Bn16 (CH::π) while its benzyl group is stacked in π-π edge-to-face interactions with Bn2 and Th18 (FIG. 8E). One additional interaction between L2 and S1 is a base triple (mA21:dG15:dC10; FIG. 8F), a recurrent motif in pseudoknots (Chen, G. et al. (2009) Proc. Natl. Acad. Sci. USA 106:12706). This is the only long-range tertiary interaction in SL5 that does not involve the modified nucleotides.

Figure 8I:
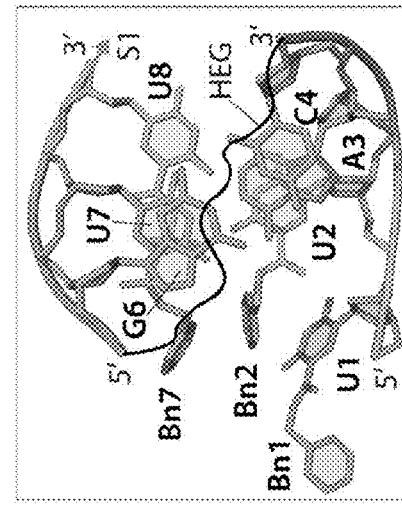
Figure 8H:
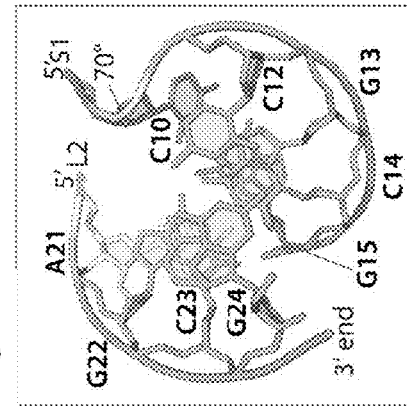
Figure 8G:
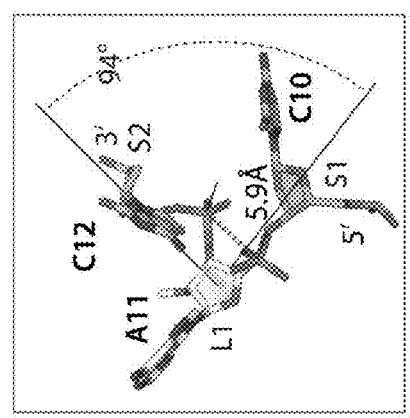

Loop 1 (L1) consists of a single extruded nucleotide, mA11 that allows the backbone to make a tight 94° turn, with the intrastrand phosphate distance between mA11 and dC12 compressing to just 5.9 Å (FIG. 8G). H-type pseudoknots often have one or two nucleotides in L1, which typically form hydrogen bonds with S2 and stack into the helical junction (Nonin-Lecomte, S. et al. (2006) Nucleic Acids Res. 34:1847; Michiels, P. J. et al. (2001) J. Mol. Biol. 310:1109). The extruded L1 nucleotide is necessary to keep the structure condensed so that the 5' stem domain can interface with the miniknot through the hydrophobic moieties of the modified nucleotides. As expected, the extruded base is not conserved (FIG. 3) and can be replaced with a single C3 spacer (FIG. 6A), however, its deletion abrogates binding, presumably due to interference with the miniknot formation.

The Watson-Crick base pairs of miniknot S1 (dA9:Bn-dU16, dC10:dG15) assemble by the favored H-type pseudoknot arrangement in which strand one of S2 leads directly into strand two of S1, providing efficient stacking of the stems (Klein, D. J. et al. (2009) Nat. Struct. Mol. Biol. 16:343). The three base pairs of S2 are composed entirely of Watson-Crick interactions and form a slightly undertwisted B-form helix (FIG. 8H). This understwisting results in helical parameters that more closely resemble A-form helices, as expected for pseudoknot topology; however, the relevance of these calculations is equivocal, given the short length of the helices in this structure. S2 does not form a conventional coaxial stack with S1 due to severe helical overwinding at the junction (twist angle of 70°) formed by dC10:dG15 of S1 and dC14:dG22 of S2. Continuous stacking of the stems is nevertheless maintained as dC14 stacks with dG15, and dG22 stacks with mA21 from the base triple (FIG. 8H). The extensive helical twist at this junction is necessary to allow mA21 to bridge the major groove of S2 while broadening the minor groove for base triple formation. This configuration is typical in pseudoknots with one or two nucleotides in L1 (Nonin-Lecomte, S. et al. (2006) Nucleic Acids Res. 34:1847; Michiels, P. J. et al. (2001) J. Mol. Biol. 310:1109).

Figure 8L:
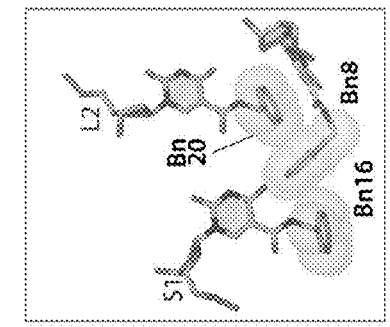
Figure 8K:
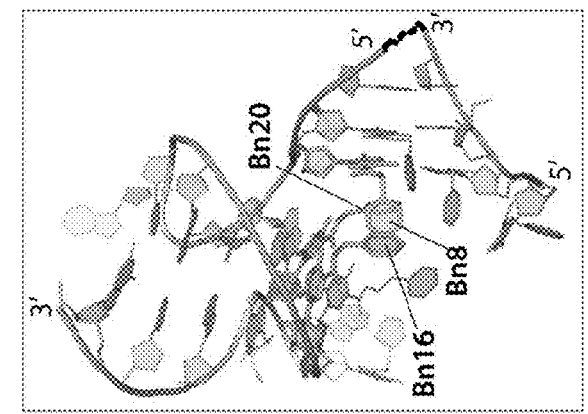
Figure 8J:
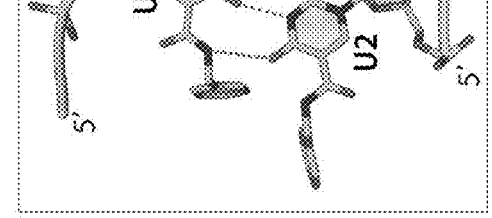
Figure 9A:
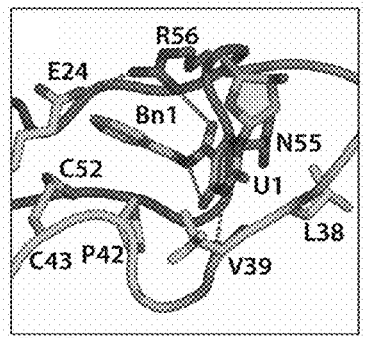
FIGS. 9A-9H illustrate certain protein-aptamer interactions, as described in Example 2.
Figure 9B:
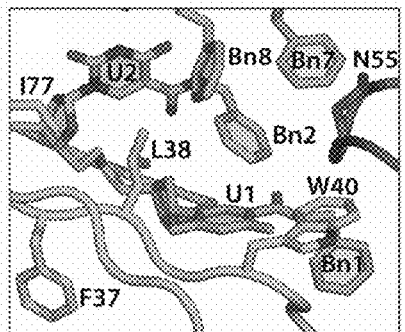
Figure 9C:
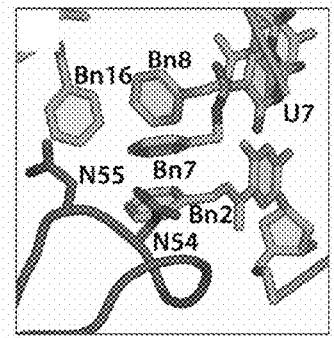
Figure 9D:
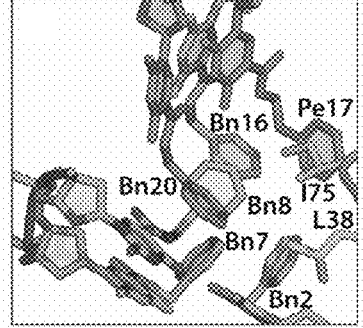
Figure 9E:
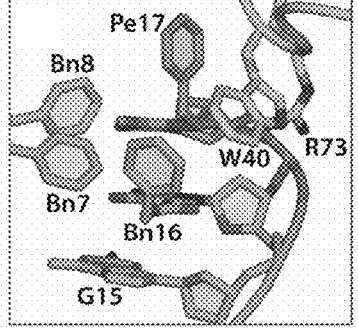
Figure 9F:
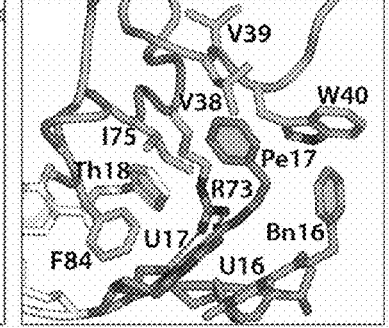
Figure 9G:
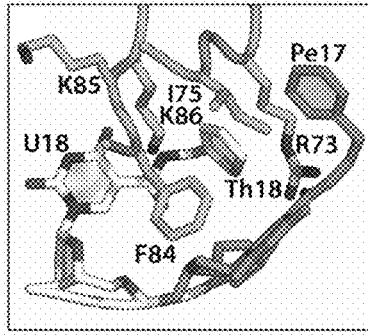
Figure 9H:
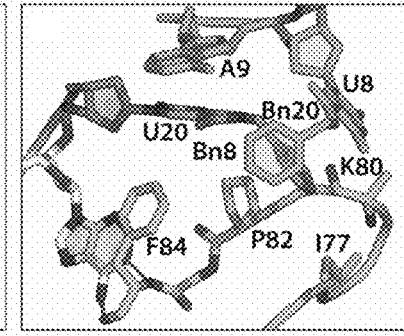

The SL5 5' stem is composed of two Watson-Crick base pairs (mA3:Bn-dU7 and dC4:dG6) and a non-canonical Bn-dU2:Bn-dU8 base pair at the base of the stem (FIG. 8I). The Bn-dU2:Bn-dU8 base pair contains two hydrogen bonds, a typical 4-carbonyl-N3 and a unique 4-carbonyl from Bn-dU2 base to amide linker of Bn-dU8 bond (FIG. 8J). Analysis of related sequences in the affinity-enriched pool shows that the length and base composition of the 5' stem can change, with the notable exception of the invariant Bn-dU:Bn-dU brace at the base of the stem (FIGS. 3A and B), highlighting the importance of this non-canonical base pair in the overall structure and function of SL5. Stability of the 5' stem helix is further bolstered by stacking of dU8, Bn20 and Pro82 of PDGF (FIG. 9H). The 5' stem-loop and miniknot domains of SL5 converge where the backbone makes a sharp 111 bend. Significant twist angles and radial displacement of the base pairs in the 5' stem results in bases 2-4 and 6-7 having greater stacking overlap (because of helix undertwisting) than in conventional B-form helices, while Bn-dU8 base is shifted out and Bn-dU7 base stacks with the amide linker of Bn-dU8 (FIG. 8I). This atypical helix facilitates critical interactions with the rest of SL5 and with PDGF; Bn-dU8 base stacks with Bn20 while Bn8 lies perpendicularly between the rings of Bn16 and Bn20 in consecutive π-π edge-to-face interactions. These long-range tertiary interaction define a precise hinge between the miniknot and the stem-loop domains (FIGS. 8L and 8K). The lack of curvature between the first two nucleotides prevents clashing of Bn-dU1 base with Bn2, augmenting stacking of the rings (FIG. 8I). Bn2 sits in the middle of a hydrophobic cluster created by Bn7 and Bn8 (from the 5' stem) and Bn16, Pe17 and Bn20 (from the miniknot) (FIG. 7B, FIG. 8I and FIG. 8K). This hydrophobic cluster contributes to stabilization of the SOMAmer, supported by the observation that SL5 exhibits a $T_m$ of 64° C., which is >30° C. higher than its analog that lacks the modified nucleotides.

Figure 1B:
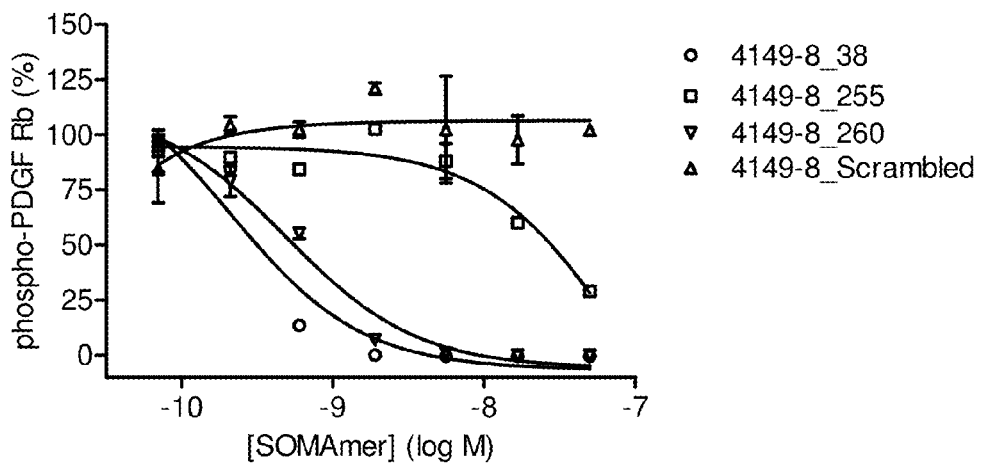
FIG. 1B shows inhibition of PDGF-BB-stimulated phosphorylation of PDGFRβ by three PDGF aptamers described herein and a scrambled control oligonucleotide.
Figure 8M:
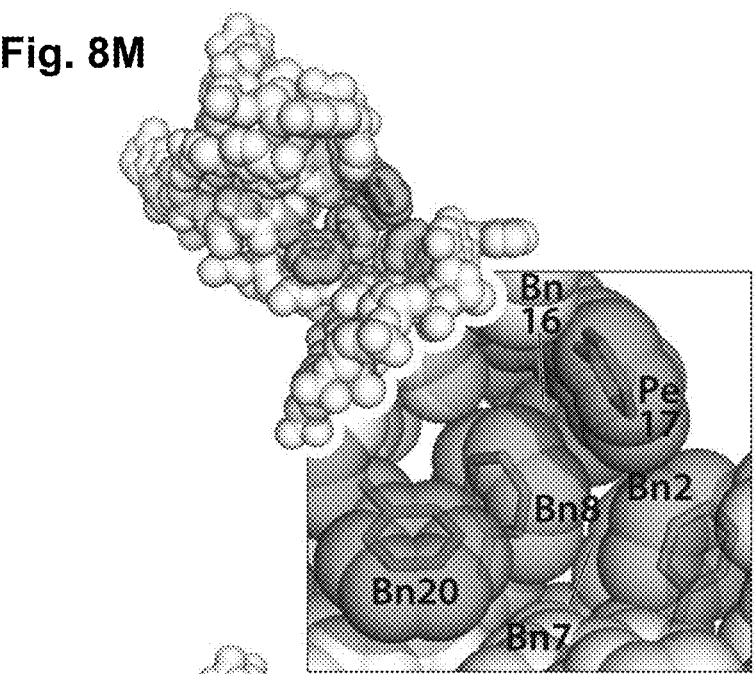
Figure 8N:
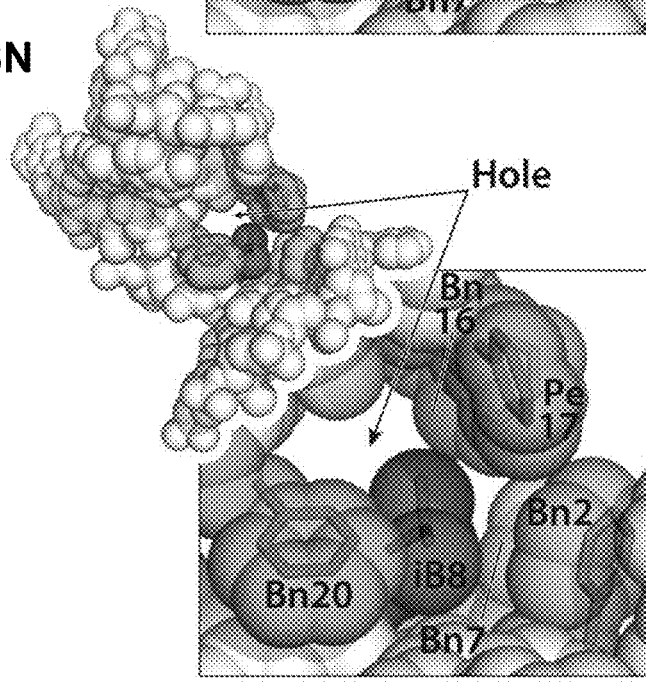

In addition to SL5, we also solved the structure of SL4 (4149-8_255), which is identical to SL5 except for the replacement of Bn-dU8 with isobutyl-dU (iB-dU). When iB-dU8 was combined with Pe-dU17 and Th-dU18 in variant SL4, the SOMAmer showed substantially weaker binding (~20-50-fold vs. SL5) and a 75-fold lower in vitro inhibitory activity (FIG. 1A, FIG. 1B and FIG. 6B). The smaller non-aromatic isobutyl side chain cannot form the energetically favorable π-π edge-to-face stacking seen with the benzyl side chains of Bn-dU20, Bn-dU8 and Bn-dU16 in SL5 (FIG. 8M and FIG. 8N). This creates a hole in the center of the hydrophobic cluster at the protein interface, effectively unlocking the hinge between the 5' stem and the miniknot domains. The structural effect of this substitution is directly analogous to a Phe to Leu mutation in the hydrophobic core of a protein. Such protein mutations are well-described (Kadonosono, T. et al. (2003) Biochemistry 42:10651; Lin, H. J. et al. (2003) Biochim. Biophys. Acta. 1649:16; Baase, W. A. et al. (2010) Protein Sci. 19:631) and usually have a significant destabilizing effect. Junctions between secondary structure motifs are known to play a critical role in determining nucleic acid tertiary structure (Pyle, A. M. et al. (2011) Curr. Opin. Struct. Biol. 21:293).

Despite markedly weaker target-binding affinity, SL4 exhibits similar thermal melting profile to SL5 in the absence of ligand ($T_m$ values of 62° C. and 64° C., respectively). This is consistent with the notion that the cavity and altered junction topology created by iB-dU8 substitution in SL4 destabilizes the protein-binding interface, while leaving the intradomain structures of the SOMAmer intact. The conformations of free SOMAmers in solution may well be very different from those in the complex with the protein, which could also diminish the relationship between $T_m$ and binding affinity. In fact, since the energetic cost of solvating a large hydrophobic surface of the SOMAmer is likely to be substantial, we expect the uncomplexed SOMAmer to collapse around the hydrophobic side chains and adopt a conformation in which the hydrophobic side chains are partially protected from the solvent.

Figure 4:
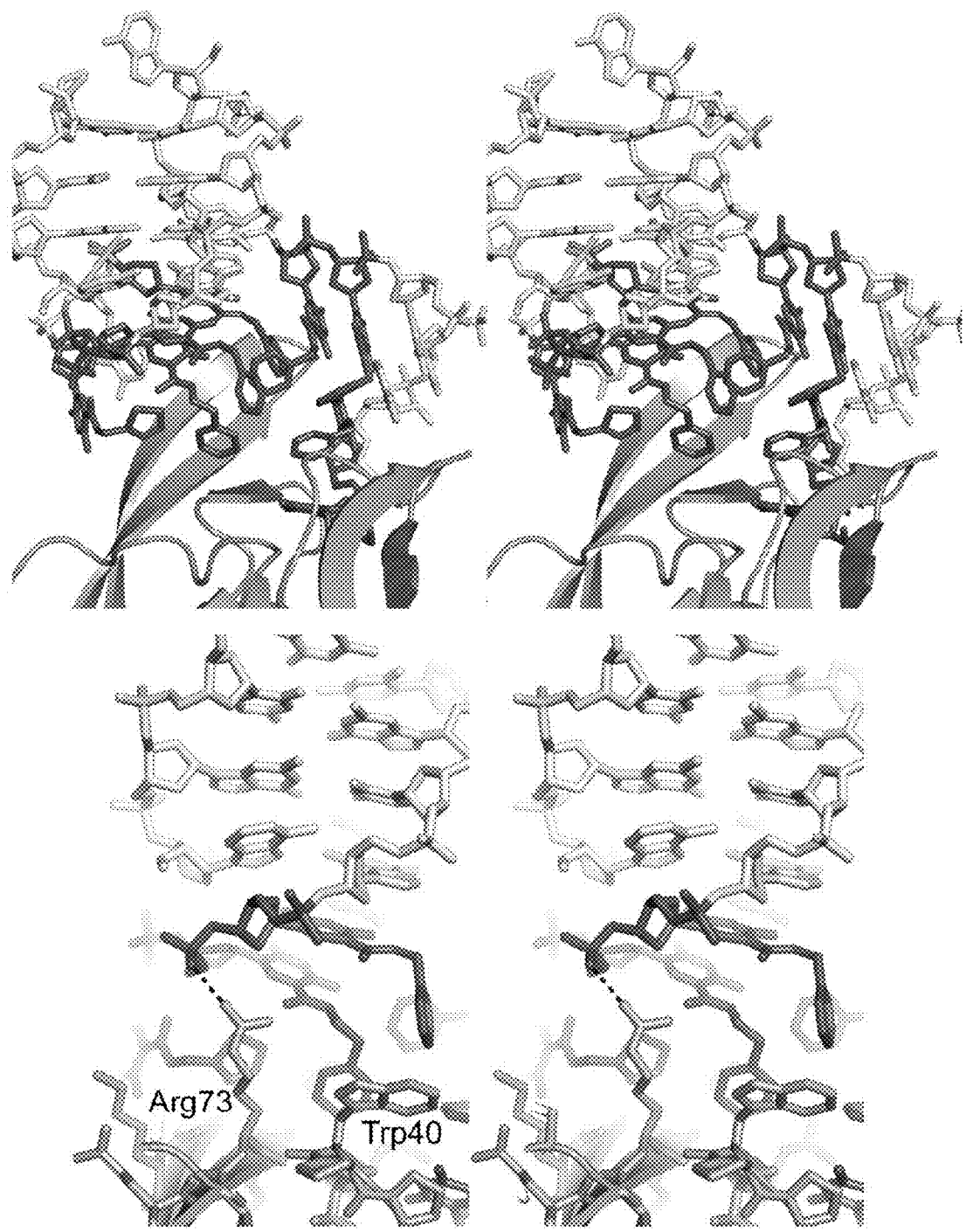
FIG. 4 illustrates certain stereoviews of a PDGF-BB: 4149-8_260 complex, as described in Example 2.
Figure 22A:
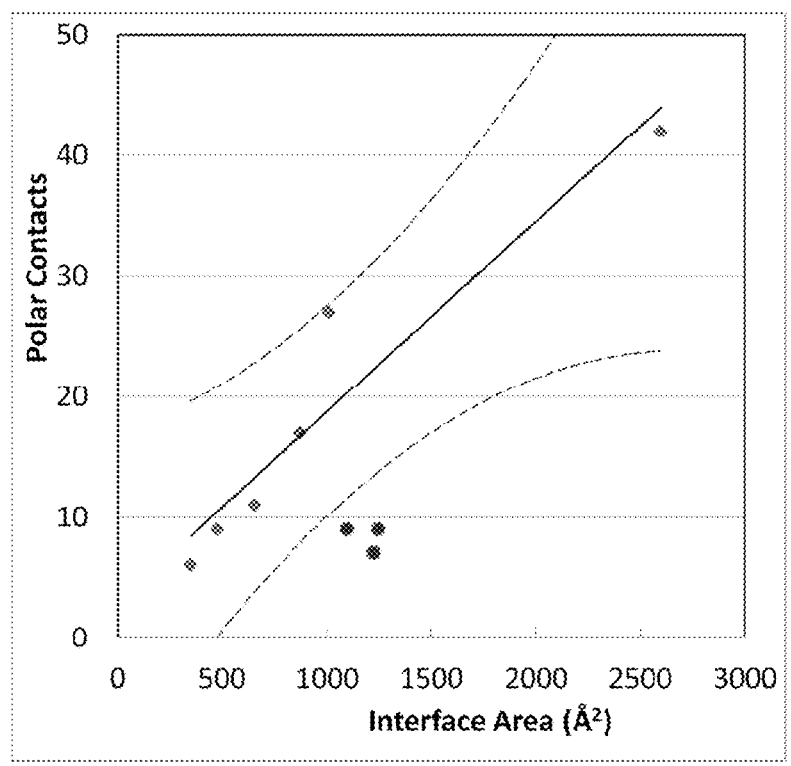
FIG. 22A shows a plot of a number of polar contacts (defined as the sum of hydrogen bonds and charge-charge interactions) versus interface area for traditional aptamers (diamonds) and SOMAmers (circles) (the linear regression fit has an $R^2=0.91$ with a slope of 0.016; dashed lines represent the 99% confidence intervals of this trend, with the SOMAmers falling outside those boundaries).
Figure 22B:
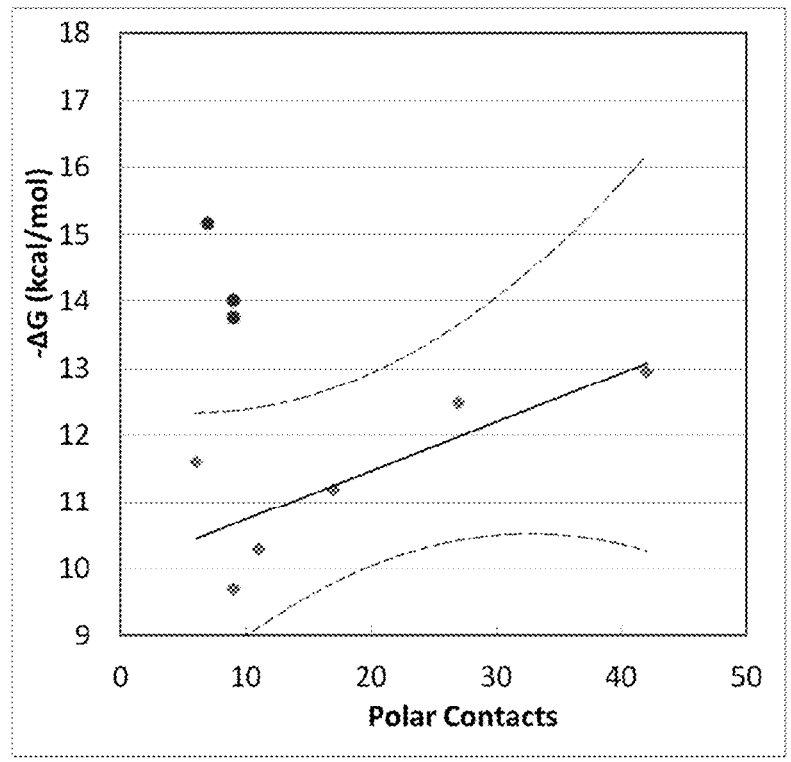
FIG. 22B shows a plot of free energy binding versus polar contacts for traditional aptamers (diamonds) and SOMAmers (circles) (the linear regression fit has an $R^2=0.64$ with a slope of 0.073)

In contrast to previously described protein:aptamer complexes, hydrophobic interactions dominate the interface between SL5 and PDGF (FIG. 2, FIG. 4 and FIG. 9). Binding to PDGF-BB creates a buried surface area of ~1225 Å$^2$ per SOMAmer. The eight modified nucleotides of SL5 create an extensive hydrophobic interface that interacts with 13 non-polar amino acids of PDGF (Ala35, Phe37, Leu38, Val39, Trp40, Pro42, Cys52, Cys53, Ile75, Ile77, Pro82, Ile83, and Phe84), which account for approximately half of the total non-polar contacts, with the remainder comprising aliphatic regions of polar or charged amino acids such as Glu24, Arg27, Asn36, Asn54, Asn55, Arg56, Arg73, Lys74, Lys80, Lys85, and Lys86 (FIG. 9). Similar interactions between completely non-polar residues and non-polar moieties of charged amino acids are often observed in proteins. Thus, the structural diversity afforded by the modified nucleotides in SOMAmers enables them to mimic the rich repertoire of interactions accessible to proteins. The striking difference in the extent of hydrophobic contacts made by the SOMAmer compared to traditional aptamers is evident when the interface atoms are displayed on the surfaces of the target proteins. SL5 exhibits remarkably few polar interactions, having just six H-bonds and one charge-charge interaction with PDGF (FIG. 4), despite close proximity to basic amino acids. Relative to the contact surface area, this is significantly lower than what is typical for aptamers. The total number of H-bonds and charge-charge interactions (that is, polar contacts) for six traditional aptamers increases approximately linearly in direct proportion to the interface area (FIG. 10A, FIG. 22A) with a correlation coefficient of 0.91 and an average of 1.9±0.4 polar contacts per 100 Å$^2$ interface area. SL5, as well as two additional SOMAmers in other co-crystal structures, clearly fall outside of the 99% confidence intervals of this trend, with less than half the number of polar contacts per interface area (average of 0.7±0.2 per 100 Å$^2$ interface area), while exhibiting a trend toward higher binding affinities for their targets (FIG. 22C). In terms of ligand efficiency (free energy of binding per non-hydrogen contact atom) (Kuntz, I. D. et al. (1999) Proc. Natl. Acad. Sci. USA 96:9997), aptamers and SOMAmers do not appear to be different (FIG. 22C), encompassing a range of values observed with protein-based and small molecule-based ligands (Wells, J. A. et al. (2007) Nature 450:1001). Free energies of binding per interface area are also similar (FIG. 22C). What is different, however, is the value of free energy of binding per polar contact, which is about twice as large for SOMAmers than for aptamers (FIGS. 22 B and C), consistent with the notion that SOMAmers derive a larger contribution to binding from hydrophobic interactions.

Charge-charge interactions often contribute less than 0.2 kcal/mol to the stability of a folded protein (Sali, D. et al. (1991) J. Mol. Biol. 220:779. In contrast, burying just a single methylene group is estimated to contribute ~1-1.5 kcal/mol to globular protein stability and/or binding interactions (Kellis, J. T., Jr. et al. (1988) Nature 333:784; Pace, C. N. et al. (2011) Mol. Biol. 408:514). SOMAmer structures reveal a strong reliance on hydrophobic interactions and in this sense, their binding to proteins more closely resemble typical protein-protein interactions. Consistent with this observation, the affinity of SL5 for PDGF shows virtually no decrease across a broad range of salt concentrations (0.1 to 1.0 M NaCl) or pH values (5.0 to 8.8), in contrast to the effects seen with traditional aptamers (Ahmad, K. M. et al. (2011) PLoS ONE 6:e27051; Tang, Q. et al. (2007) J. Colloid. Interface. Sci. 315:99).

Post-SELEX optimization facilitates fine tuning of shape complementary and hydrophobic packing interactions. For example, the exceptional shape complementary of Pe-dU17 and Th-dU18 at the protein interface (FIG. 10B) is corroborated with the structure-activity relationships (FIG. 6B). Bn-dU1 also forms a unique interaction with PDGF-BB, with the benzyl ring sitting in a tunnel formed by the Cys43-Cys52 disulfide bond and a salt bridge between Glu24 of PDGF chain1 and Arg56 of chain 2 (FIG. 10C). The crystal structure suggests that the binding pocket can accommodate a variety of side chains, including larger bicyclic substituents, thereby enhancing this point of contact with the protein. Indeed, we have identified several modified nucleotide substitutions at this position that confer 5- to 10-fold enhancement in binding affinity (FIG. 6B).

Figure 11A:
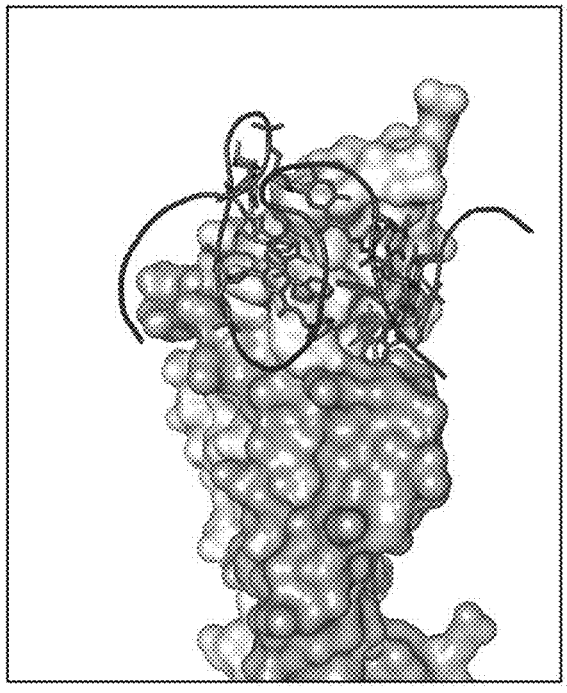
FIGS. 11A-11C show a comparison of SL5 and PDGFRβ binding to PDGF-BB.
Figure 11B:
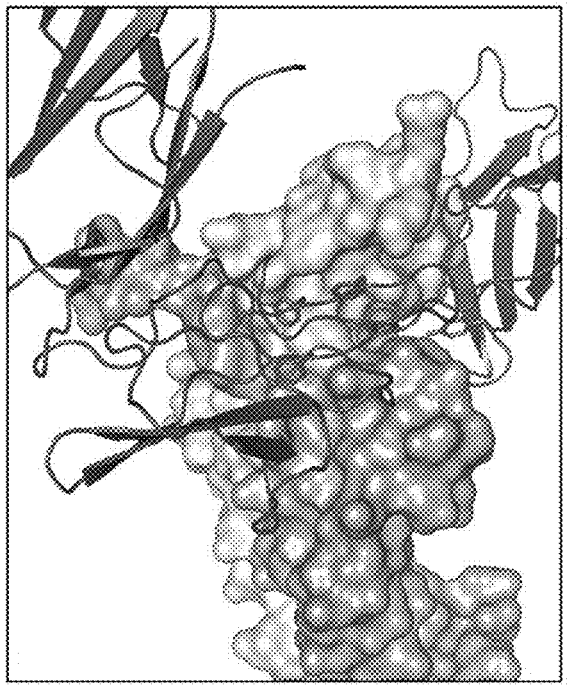
Figure 11C:

A notable feature of the PDGF-BB:SL5 structure is the degree to which the SOMAmer mimics PDGFRβ. The receptor binds to PDGF primarily through hydrophobic interactions, including seven hydrophobic amino acids at the PDGF interface (Shim, A. H. et al. (2010) Proc. Natl. Acad. Sci. USA 107:11307). SL5 binding site largely overlaps that of the receptor with the Bn-dU aromatic rings occupying the same hydrophobic groove on the protein (FIG. 11). PDGF contacts both the receptor and SL5 with 24 residues, of which 10 are shared. These shared or "promiscuous" residues likely represent a hot spot of binding energy on the surface of PDGF (Wells, J. A. et al. (2007) Nature 450:1001; Clackson, T. et al. (1994) Science 267:383. However, compared with PDGF Rβ, SL5 exhibits a 10-fold higher affinity for PDGF-BB (Lokker, N. A. et al. (1997) J. Biol. Chem. 272: 33037). Consistent with these observations, SL5 is a potent inhibitor of PDGF-BB (FIG. 1B and FIG. 6B).

Example 3. Binding Affinity Assays

For determination of target binding affinity, SOMAmers were 5' end-labeled using T4 polynucleotide kinase (New England Biolabs) and γ-$^{32}$P-ATP (Perkin Elmer). Binding assays were performed by incubating radiolabeled SOMAmer (~20,000 c.p.m) at a concentration of ~0.03-0.05 nM and target protein at concentrations ranging from $10^{-7}$ to $10^{-12}$ M in 1×SB18T buffer (40 mM HEPES, pH 7.5; 120 mM NaCl; 5 mM KCl; 5 mM MgCl$_2$ and 0.01% TWEEN-20) at 37° C. for 30 minutes. Bound complexes were mixed with Zorbax resin and captured on Durapore filter plates. The fraction of SOMAmer bound was quantified with a PhosphorImager (FUJI FLA-3000). Raw binding data were corrected for nonspecific background binding of radiolabeled SOMAmer to Zorbax resin. Equilibrium dissociation constants ($K_d$) was determined as previously described (Jellinek et al. (1993) Proc. Natl. Acad. Sci. 91:11227). Competitor tRNA at a concentration of 200 nM was included in isoform specificity studies as indicated in FIG. 5. To determine the salt dependence on the PDGF-BB/SOMAmer and E10030 interactions, binding affinity assays were performed and analyzed as described above in the presence of 40 mM Hepes pH 7.5, 0.01% TWEEN-20 and either 100 mM, 250 mM, 500 mM, 750 mM or 1.0 M NaCl). The log-log plots of the salt concentrations versus the dissociation constants were fit using simple linear regression. The slope of the plots represents the number of counter-ions released from the DNA upon protein binding, as described by the counter-ion condensation theory of (Manning, G. S. (1969) J. Chem. Phys. 51:924). The affinity of aptamer 4149-8_260 (SEQ ID NO. 211) for PDGF showed little change across a broad range of salt concentrations (0.1 to 1.0 M NaCl) or pH values (5.0 to 8.8), in contrast to the effects seen with traditional aptamers (Ahmad, K. M. et al. (2011) PLoS One 6:e27051; Tang, Q. et al. (2007) J. Colloid. Interface Sci. 315: 99).

Example 4. PDGF-BB Cellular Phosphorylation Assay

PDGF-BB Activity.

Figure 13:
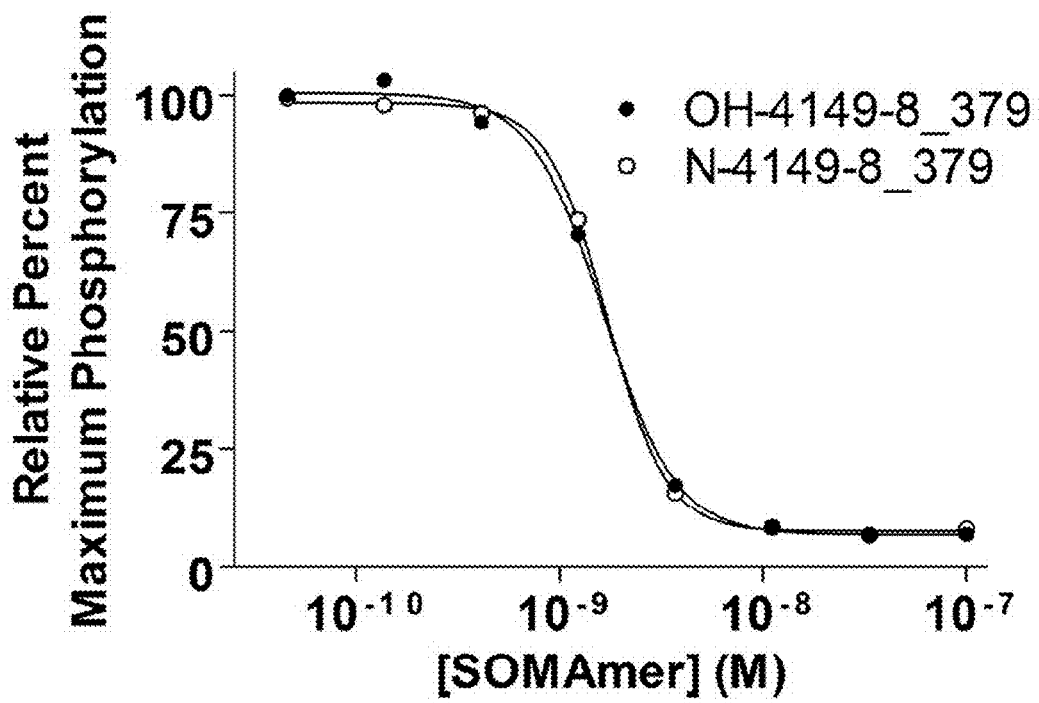
FIG. 13 shows a representative plot of the inhibition of PDGF-BB-induced PDGF Rβ phosphorylation in Hs27 fibroblasts with SOMAmers 4149-8_379 (labeled as OH-4149-8_379) or 5' amino-linker modified SOMAmer 4149-8_379 (labeled as N-4149-8_379), as described in Example 4.

For testing the ability of PDGF-BB SOMAmers to inhibit PDGF Rβ activation, Hs27 human foreskin fibroblast cells (American Type Culture Collection) were seeded at 5000 cells/well into a 96-well plate, and serum-starved for 24 hours. SOMAmers (varying concentrations as indicated in the figures) were incubated with PDGF-BB (20 ng/mL) (Creative BioMart) in serum-free media for 30 minutes at 37° C., then the complex was added to serum-starved Hs27 cells. At five minutes post stimulation, the supernatant was discarded and the cells were lysed in Lysis Buffer #9 (R&D Systems: 1% NP-40 Alternative, 20 mM Tris (pH 8.0), 137 mM NaCl, 10% glycerol, 2 mM EDTA, 1 mM activated sodium orthovanadate, 10 μg/mL Aprotinin, and 10 μg/mL Leupeptin) on ice for 5 minutes. Elisa detection of phospho-PDGF Rβ was performed using the DuoSet Phospho-PDGF Rβ kit (R&D Systems) according to the manufacturer's instructions. The percent phospho-PDGF Rβ was measured at $OD_{450}$, corrected for plate absorbance and background signal with a no stimulant control. Experiments were generally performed in duplicate or triplicate. Data were plotted in GraphPad Prism 3.0 and fit to a one site competition curve using nonlinear regression. Representative plot of the $IC_{50}$ determination is shown in FIG. 13 for SOMAmers 4149-8_379 and 5' amino-linker modified SOMAmer 4149-8_379, with $IC_{50}$ values of 1.6 nM and 1.7 nM, respectively.

For activity screening of variants of clone 4149-8, percent inhibition of PDGF-BB-induced PDGF Rβ phosphorylation in Hs27 fibroblasts, under the same conditions as described above but at a single concentration of SOMAmer variants (generally 20 nM), was evaluated.

Example 5. Additional PDGF Ligands Based on Nap-dU Modification

To identify additional aptamers that bind to PDGF-BB with high affinity, we have performed another SELEX experiment with a library comprising Nap-dU modified nucleotides. The selections were performed in a manner substantially analogous to the one described in Example 1 above and resulted in the identification of the Nap-dU aptamer clone 5169-4.

Deep Sequencing of PDGF Nap-dU SELEX Pool:

To evaluate more completely the sequences within the 5169-4_1 aptamer family, the 7$^{th}$ round pool was sequenced using 454 pyrosequencing technology. The pool DNA was amplified with 454 primers and the PCR product was purified and normalized using a Sequal normalization plate (Invitrogen, Cat# A10510-01). The eluate was run on a gel to confirm the size and purity of each amplicon. The purified PCR product was sequenced at the 454 pyrosequencing facility at the University of Colorado Health Sciences Center in Aurora, Colo.

The sequence data set from the pool contained 8,273 full length sequences (i.e., those sequences containing both primer sequences) of which 1,629 were unique. These 1,629 unique sequences were used to find statistically significant n-mer patterns by counting all possible n-mers in the sequence set, from 4-mers to 30-mers. By comparing the counts for each identified n-mer to counts expected at random for n-mers from a pool of the same composition, statistically significant patterns were found. Two major patterns were identified in the sequence set and 5169-4_1 was found aligned within the second pattern defined by the conserved sequence motif "APGPAPGCACAPCP" found in 11 sequences. A search through all unique sequences for this motif (identity=0.75) found 51 sequences that were then aligned by the motif. For all the sequences, the fractional identity at each position in the alignment was calculated as listed in FIG. 14, with the consensus sequence indicated.

Sequence Truncation Studies:

Systematic truncation from the 5' and 3' ends of the 50-nucleotide 5169-4 clone was performed to define a minimum length required to retain full binding activity of the aptamer to human PDGF-BB, as shown in Table 6. $K_d$ values for these truncations are shown (P=Napthyl-deoxyuridine (Nap-dU); A, C, G and T are deoxyribonucleotides). The 5169-4 clone proved highly amenable to truncation and a 21-nucleotide sequence was identified (5169-4_26) that bound to PDGF-BB with improved binding affinity compared to the 50-mer (17 pM and 29 pM, respectively). The 5169-4_26 21-mer contained 5 Nap-dU modified nucleotides versus 9 Nap-dU modified nucleotides in the 50-mer.

C3 Spacer Single Substitutions in 5169-4_26 (21-Mer):

The first round of post-SELEX modifications of the Nap-dU PDGF-BB aptamer included a C3 spacer walk at all positions in the 21-mer 5169-4_26. The C3 spacer walk is meant to identify bases not required for high affinity binding that could potentially be removed altogether, replaced with the C3 spacer or other linkers such as hexaethylene glycol (Heg) or polyethylene glycol (PEG) linkers. The results for the C3 spacer substitutions are shown in Table 7. In this table, "P" denotes Nap-dU, "C3" denotes C3 spacer; A, C and G denote deoxyribonucleotides, and "NB" denotes no binding up to 100 nM PDGF-BB. Three sites tolerated C3 substitution with a modest decrease in binding affinity: C1, G6 and C7 (numbering refers to the 21-mer, as shown below). One position, C15, tolerated a C3 spacer substitution with no effect on the binding affinity, compared to 5169-4_26.

2'-O-Methyl Single Substitutions in 5169-4_26 (21-Mer):

2'O-methyl substitutions were made at all natural bases in order to identify positions that could tolerate this nuclease-resistant substitution. With the 2'O-methyl Nap phosphoramidite synthesized in our laboratories (Nap-mU), we also evaluated the Nap-dU positions that would tolerate Nap-mU single substitutions. In addition, deoxythymidine (T) was substituted for Nap-dU to assess the importance of each Nap-dU. The binding affinity results are shown in Table 8, and demonstrate that all positions tolerated 2'O-methyl substitutions to varying degrees. The effect of 2'O-methyl substitutions at each deoxycytidine position (C) resulted in no change in the binding affinity, compared to 5169-4_26, up to a 2-fold decrease in binding affinity. The four deoxyguanosine positions (G) showed varying results when substituted with 2'O-methyl from 2.5-fold increased binding affinity at G14, to 5.5-fold decreased binding affinity at G10, compared to 5169-4_26. The 2'O-methyl substitutions at the six deoxyadenosine positions (A) had from zero to greater than 50-fold adverse effect on the binding affinity. The deoxyadenosines towards the 5' end of the aptamer (A3, A5 and A8) were the three most sensitive to 2'O-methyl substitution. Only the Nap-dU at position 21 completely tolerated Nap-mU substitution with no effect on the binding affinity while the Nap-mU substitution at position 11 showed a 2.5-fold decrease in binding affinity, compared to 5169-4_26. The remaining Nap-mU substitutions resulted in a 15- to 30-fold decrease in binding affinity. The only substitutions that completed eliminated binding (at PDGF-BB concentrations up to 100 nM) were the deoxythymidine substitutions at positions 12 and 21, with the remaining deoxythymidine substitutions having a significant negative affect (>400 fold) on the binding affinity. In Table 8, P=5-naphthalene modified dU, a superscript 1 indicates a 2'-O-methyl modified nucleoside. A, C, G, and T represent the naturally occurring deoxyribonucleotides and "NB" denotes no binding up to 100 nM PDGF-BB.

Multiple 2'-O-Methyl Substitutions in 5169-4_26 (21-Mer).

The combined effects of 2'-O-methyl substitutions in 5169-4_26 lead to the identification of several variants with improved binding affinity, including variant 5169-4_146. This 21-mer has 11 positions that are nuclease-protected by 2'O-methyl and its binding affinity is at least 20-fold greater than the parent truncate, 5169-4_26 (0.60 pM vs 17 pM, respectively). Many other variants also had significant improvements (approximately 3-fold) in binding affinity with combinations of 3 to 10 2'O-methyls. In Table 9, P=5-naphthalene modified dU, a superscript 1 indicates a 2'-O-methyl modified nucleoside, A, C and G represent the naturally occurring deoxyribonucleotides and "NB" denotes no binding up to 3.2 nM PDGF-BB.

Example 6. PDGF Nap-dU Aptamer Activity Assay

To analyze the inhibitory impact of PDGF Nap-dU aptamers on PDGF Rβ activation cellular phosphorylation inhibition assays were performed as described in Example 4. The four aptamer sequences tested inhibited PDGF Rβ activation with $IC_{50}$ values as follows: 5169-4_26, $IC_{50}$=1.6 nM; 5169-4_84, $IC_{50}$=3.3 nM; 5169-4_85, $IC_{50}$=7.3 nM; 5169-4_112, $IC_{50}$=1.0 nM.

Example 7. VEGF Aptamer Selection and Sequences

Preparation of Candidate Mixtures:

A candidate mixture of partially randomized ssDNA oligonucleotides was prepared by polymerase extension of a DNA primer annealed to a biotinylated ssDNA template.

VEGF SELEX Conditions:

Aptamers to recombinant human VEGF-121 protein (both from R&D Systems) were selected by SomaLogic Inc, as described (Gold et al. (2010) PloS One 5:e15004), from a library containing a 40-nucleotide random region in which Nap-dU was substituted for dT. For VEGF-121, the forward primer was 5'-GCCACACCCTGCCCTC-3' (SEQ ID NO. 844) and the reverse primer was 5'-GAGGACACAGACAGACAC-3' (SEQ ID NO. 845). VEGF-121 protein was biotinylated and partitioned on streptavidin MyOne-SA (Dynal) beads. Preferential selection of aptamers with slow dissociation rates was achieved using a kinetic challenge wherein protein-DNA complexes were incubated in the presence of 10 mM dextran sulfate at 37° C. with increased incubation times and decreased protein concentrations in successive rounds. In the VEGF-121 SELEX, rounds 4 and 5 included a 15 minute kinetic challenge while rounds 6 and 7 (final round) included a 30 minute kinetic challenge.

The smallest alternatively spliced form of vascular endothelial growth factor, VEGF-121, is a difficult protein target for SELEX. With naturally occurring DNA or RNA libraries, or with nucleic acid libraries modified at the 2'-position of ribose, we have previously failed to obtain even a modest degree of affinity improvement. This is notable for two reasons. First, among members of the cystine knot superfamily, VEGF-121 has the highest structural similarity to PDGF-BB, with a root-mean-square deviation of 1.9 Å for 124 Cα atoms (Muller et al., 1997). Second, the larger and the most prevalent VEGF isoform, VEGF-165, has proved to be a good target for SELEX. For example, pegaptanib (Macugen), the only aptamer-based therapeutic to have received regulatory approval to date (for the treatment of macular degeneration), binds only to VEGF-165 through the heparin-binding exon-7-encoded domain, which is lacking in VEGF-121 (Lee et al., 2005; Ruckman et al., 1998). One difference between VEGF-121, VEGF-165 and PDGF-BB is the overall charge, with pI values of 5.8, 8.5 and 10.1, respectively. This points to the importance of polar interactions in aptamer binding. Successful affinity enrichment for VEGF-121 was ultimately achieved with a SELEX Nap-dU library.

Identification of VEGF-121 Nap-dU Aptamer Sequences:

Two highly related high affinity variants that differ at a single position (4867-15 and 4867-31) were identified from a Nap-dU SELEX experiment performed as described above. Clone 4867-31 has been truncated to a 29-mer in a series of deletion experiments (Table 7). It is worth noting that truncation of both high affinity clones (4867-15 and 4867-31) results in the same 29-mer since the single nucleotide difference is outside the 5' boundary of the minimal sequence. Truncated variants that encompass the shorter sequence with high affinity biding, 29-mer 4867-31_143 (5'-CCGPP CAAGP GCPPG PAGGA PPPAA APGG-3' (SEQ ID NO: 849) where "P" is the single-letter designation for Nap-dU) and its close variants, bind to human VEGF-121, human VEGF-165, mouse VEGF-120 and rat VEGF-164 with comparable affinities, ranging from 0.1-1 nM (Table 10). In this table, "P" denotes Nap-dU; A, C, and G denote the naturally occurring deoxyribonucleotides and "NB" denotes no binding up to 100 nM VEGF.

C3 Spacer Single Substitutions in 4867-15_2 (50-Mer).

The first round of post-SELEX modifications of the VEGF-121 aptamer was a C3 spacer walk at all positions in the 50mer 4867-15_2 (truncated 50-mer). The C3 spacer walk is meant to identify bases not required for high affinity binding that could potentially be removed altogether, replaced with the C3 spacer or other linkers such as hexaethylene glycol (Heg) or polyethylene glycol (PEG) linkers. The results for the C3 spacer substitutions are shown in Table 11. In this table, "P" denotes Nap-dU, "V" denotes C3 spacer; A, C, and G denote the naturally occurring deoxyribonucleotides and "NB" denotes no binding up to 100 nM VEGF. At least three internal sites tolerated C3 substitution: C17, G26 and G29 (numbering refers to the 50-mer, as shown below).

2'-O-Methyl Single Substitutions in 4867-31_43 (32-Mer).

2'O-methyl substitutions were made at natural bases in order to identify positions that could tolerate this nuclease-resistant substitution. In addition, 2'-OMe-uridine (2'-OMeU) was substituted for Nap-dU to assess the importance of each Nap-dU. In addition, C3 spacers were tested at certain internal positions hypothesized to be extruded bases, now in the context of the 32mer. Internal deletions and alternative bases were tested at each of the three positions as well. The binding affinity and cell culture inhibition data for select SOMAmers (single concentration of 20 nM) are shown below. The results are shown in Table 12, and demonstrate that C8 (C17 in Table 11) did not completely tolerate substitution to C3 in the context of the shorter truncate. The other two putative extruded bases (G17 and G20) retain good binding and functional activity as C3 or alternative base substitutions in this context. Internal deletions at those positions were not tolerated. None of the Nap-dU modifications could be replaced with 2'OMe-U in this experiment. Several internal sites tolerated 2'OMe modifications, however. In Table 12, P=5-naphthalene modified dU, and a superscript 1 indicates a 2'-OMe modified nucleoside, V=3 carbon spacer, and an empty box indicates a nucleoside deletion. A, C, G, and U represent the naturally occurring deoxyribonucleotides.

2'-O-Methyl Nap-dU Substitutions and Multiple 2'-O-Methyl Substitutions in 4867-31_143 (29-Mer).

With the 2'O-methyl Nap phosphoramidite synthesized in our laboratories (Nap-mU), we evaluated the Nap-dU positions that would tolerate Nap-mU single substitutions. In addition, we tested combinations of 2'OMe and C3 linker substitutions at each of the natural bases. The binding affinity and cell culture inhibition data for select SOMAmers (single concentration of 20 nM) are shown below. As shown in Table 13 below, most of the Nap-dU residues did not tolerate OMe substitution, but substitution of Nap-mU for Nap-dU at position 22 gave a 10-fold increase in affinity, and excellent inhibitory activity. In this table, superscript "1" denotes 2'-O-methyl substitution, "V" denotes C3 spacer. The 2'-OMe combinations were mostly well-tolerated based on affinity, but certain combinations showed a striking loss of inhibitory activity.

The combined effects of 2'-O-methyl and C3 substitutions led to the identification of several variants with improved binding affinity, including variant 4867-31_188. This 29-mer has 10 positions that are nuclease-protected by either 2'OMe or C3 and its binding affinity is about 3-fold tighter than the parent truncate, 4867-31_143 (38 pM vs 140 pM, respectively). Variant 4867-31_188 retains comparable cellular inhibition activity relative to the parent SOMAmer. See Table 13.

The only position that tolerated Nap-mU was nucleotide 22 (using 4867-31_143 truncate as the parent sequence). This Nap-mU substitution was next placed into the background of the best combined 2'OMe SOMAmer, 4867-31_188. In addition, the substitution of the original dG at position 15 with a C3 spacer was compared with 2'-OMe substitution at that position to examine the possibility that nuclease-protected base might add rigidity to the molecule and hence increase binding. The best aggregate result was obtained with variant 4867-31_192, which now has 9 protected positions compared to the parent 29-mer truncated variant 4867-31_143 (see Table 14 below; superscript "1" denotes 2'-O-methyl substitution and "V" denotes C3 spacer).

Figure 15:
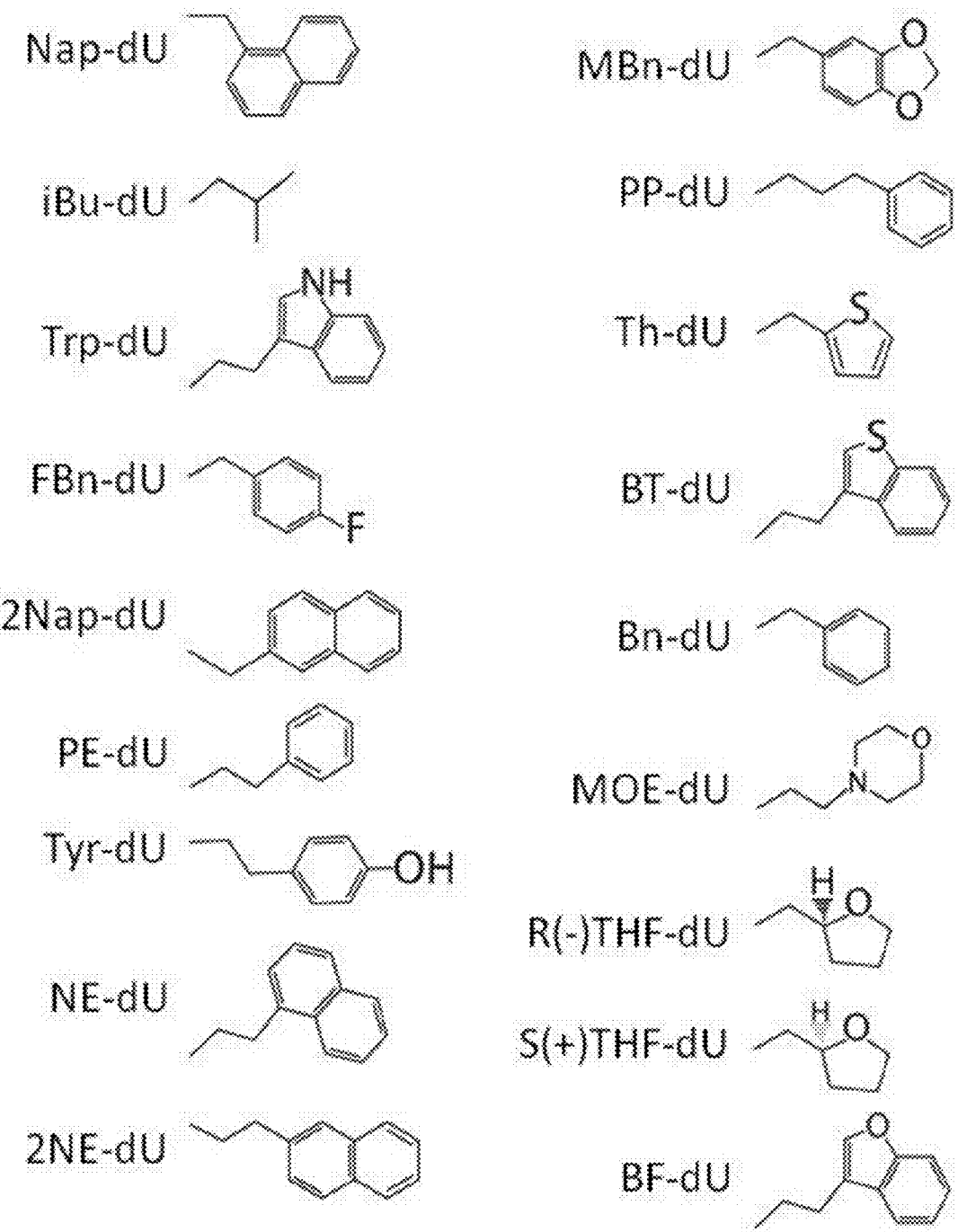
FIG. 15 shows $K_d$ ratios for modified aptamers based on parent aptamer 4867-31_143, in which a particular Nap-dU nucleobase has been replaced by another modified dU nucleobase, relative to the parent aptamer (numbers <1 indicate the modified aptamer has greater affinity than the parent aptamer, and numbers >1 indicate the modified aptamer has lower affinity than the parent aptamer); as described in Example 7.

Modified Nucleotide Structure Activity Relationship and Affinity Maturation:

To examine the contribution of each of the ten napthyl side chains to binding, we performed another series of systematic point substitutions by chemically synthesizing 5-position variants with a custom-made library of modified dU phosphoramidites. For this purpose, we designed a library to allow us to probe the microenvironment of each of the positions by varying the size, polarity, disposition of H-bond donors and acceptors, linker length, and orientation of the 5-position substituents. In choosing the functional groups for this analysis, we aimed to include variations on a theme of the original modification (in this case, the napthyl group), amino acid side chains overrepresented in complementarity determining regions (CDRs) of antibodies (like tryptophan and tyrosine) (Mian, I. S. et al. (1991) J. Mol. Biol. 217:133; Ramaraj, T. et al. (2012) Biochim. Biophys. Acta. 1824:520), and "privileged" fragments of small-molecule drugs (17). FIG. 15 shows the results of these substitutions, represented as the ratio of $K_d$ values (substituted/unsubstituted). Of the 17 different modification substitutions tested each of the ten Nap-dU positions, only four substitutions (Trp-dU 27, NEdU 16, MBn-dU 10 and BT-dU 16) had little to no effect of the binding affinity. All other substitutions resulted in weaker binding affinity, to varying degrees.

Deep Sequencing of VEGF SELEX Pool:

To evaluate more completely the sequences within the 4149-8_1 aptamer family, the enriched pool was sequenced using 454 pyrosequencing technology. The pool DNA was amplified with 454 primers and the PCR product was purified and normalized using a Sequal normalization plate (Invitrogen, Cat#A10510-01). The eluate was run on a gel to confirm the size and purity of each amplicon. The purified PCR product was sequenced at the 454 pyrosequencing facility at the University of Colorado Health Sciences Center in Aurora, Colo.

The 454 sequences were aligned with 4867-31 by CLUSTAL analysis. The sequence data set from the pool contained 13,139 full-length sequences (i.e., those sequences containing both primer sequences) of which 2,235 were unique. These 2,235 unique sequences were searched for the motif 5'-CCGPP CAAGP GCPPG PAGGA PPPAA APGG-3' (SEQ ID NO: 846). There were 86 sequences found that contained this motif. For all the sequences, the percentage identity at each position with 4867-31 was calculated as listed in FIG. 16.

Example 8. VEGF Binding Affinity Assays

For determination of target binding affinity, SOMAmers were 5' end-labeled using T4 polynucleotide kinase (New England Biolabs) and $\gamma$-$^{32}$P-ATP (Perkin Elmer). Binding assays were performed by incubating radiolabeled SOMAmer (~20,000 c.p.m) at a concentration of ~0.03-0.05 nM and target protein at concentrations ranging from $10^{-7}$ to $10^{-12}$ M in 1×SB18T buffer (40 mM HEPES, pH 7.5; 120 mM NaCl; 5 mM KCl; 5 mM $MgCl_2$ and 0.01% TWEEN-20) at 37° C. for 30 minutes. Bound complexes were mixed with Zorbax resin and captured on Durapore filter plates. The fraction of SOMAmer bound was quantified with a PhosphorImager (FUJI FLA-3000). Raw binding data were corrected for nonspecific background binding of radiolabeled SOMAmer to Zorbax resin. Equilibrium dissociation constants ($K_d$) was determined as previously described (Jellinek et al. (1993) Proc. Natl. Acad. Sci. 90:11227).

Example 9. VEGF Activity Assay

To analyze the inhibitory impact of VEGF121 SOMAmers on the cellular kinase activity of VEGF-R2 (Vascular Endothelial Growth factor Receptor 2), we used human umbilical vein endothelial cells (HUVECs) (Lonza, #CC-2519) which expresses endogenously high level of VEGF-R2. HUVEC cells were plated in EGM-2 (Endothelial Cell Growth Medium) supplemented with EGM-2 BulletKit (#CC-3162) containing 2% FBS, growth factors (hEGF, Hydrocortisone, VEGF, HFGF-B, Rβ-IGF-1), heparin, ascorbic acid and GA-1000 (Gentamicin, Amphotericin-B). When HUVEC cells reached 70 to 80% confluence, they were plated in 24-well plate ($10^5$ cells/well) and starved overnight with serum-free medium.

SOMAmers (a single concentration at 20 nM or a range of concentrations) were added to the cultures with 20 ng/mL (1 nM) of VEGF-121 (R&D System, #4464-VS) containing 1% BSA at 37° C. for 30 minutes. The cells were washed in PBS two times and stimulated with the pre-incubated VEGF-121/SOMAmers complex for 5 minutes. The treated cells were washed again with PBS two times and added ice-cold lysis buffer (1% NP-40 Alternative, 20 mM Tris (pH8.0), 137 mM NaCl, 10% glycerol, 2 mM EDTA, 1 mM activated sodium orthovanadate, 10 µg/mL Aprotinin and 10 µg/mL leupeptin supplemented with a Halt phosphatase inhibitor (Thermo Scientific, #78428). The cell lysates were measured for phosphorylation of VEGF-R2 by using Human Phospho-VEGF R2/KDR Kit (R&D, DYC 1766-2).

Figure 17:
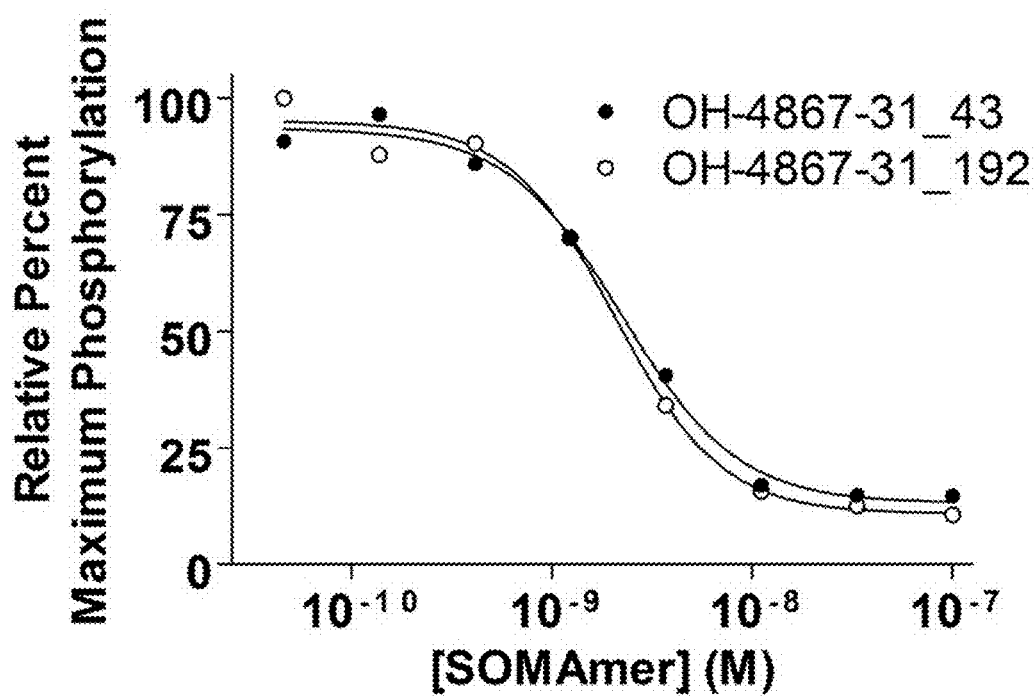
FIG. 17 shows percent VEGFR2 phosphorylation in human umbilical vein endothelial cells (HUVECs) stimulated with VEGF-121 or VEGF-165 and VEGF aptamers 4867-31_43 and 4867-31_192, as described in Example 9.

In functional activity experiments in vitro, various truncated variants of clone 4867-31 at a screening concentration of 20 nM are capable of essentially completely inhibiting VEGFR2 phosphorylation induced by VEGF-121 or VEGF-165 (1-4 nM) in immortalized or primary human umbilical vein endothelial cells (HUVECs). A representative plot of the $IC_{50}$ determination is shown in FIG. 17 for VEGF aptamers 4867-31_43 and 4867-31_192, with $IC_{50}$ values of 2.2 nM and 2.1 nM, respectively.

For activity screening of variants of clone 4867-31, we have evaluated percent inhibition of VEGF-induced VEGF R2 phosphorylation in HUVECs, under the same conditions as described above but at a single concentration of SOMAmer variants (generally 20 nM).

Example 10. Homodimer Constructs of PDGF and VEGF Aptamers

Both PDGF-BB and VEGF are disulfide linked homodimers that exert their biological effects by dimerizing their tyrosine kinase receptors leading to receptor autophosphorylation and signal transduction. If more than one aptamer can bind to its protein target, as is the case with PDGF-BB aptamer 4149-8_260 (based on the crystal structures), such aptamers can be covalently linked in a multimeric construct in a manner that permits simultaneous binding of individual aptamer subunits to the protein. This can lead to improvement in affinity through avidity effect. Two types of homodimers were synthesized, based on readily available chemistry. These were 1) head-to-tail homodimers connected by zero to six Heg linkers, which provide ~20 Å distance per Heg, and 2) 3'-3' homodimers connected via a synthetic doubler support, combined with one to three Hegs on each side (that is, two, four or six Hegs total in the dimer). The homodimers of 4149-8_379, 5169-4_26 and 4867-31_192 were tested in a competition binding assay. For determination of competitor binding affinities, aptamer ligands were 5' end-labeled using T4 polynucleotide kinase (New England Biolabs) and γ-$^{32}$P-ATP (Perkin Elmer). Competition assays were performed by pre-mixing a fixed concentration of radiolabeled ligand (1.0 nM) with varying concentrations of competitor aptamer ($10^{-11}$ to $10^{-6}$ M). The ligand and competitor dilutions were incubated with the target protein (100 pM) in 1×SB18T buffer (40 mM HEPES, pH 7.5; 120 mM NaCl; 5 mM KCl; 5 mM $MgCl_2$ and 0.01% TWEEN-20) at 37° C. for 60 minutes. Bound complexes were mixed with Zorbax resin and captured on Durapore filter plates. The fraction of ligand bound was quantified with a PhosphorImager (FUJI FLA-3000). Raw binding data were normalized to binding without addition of competitor. Data were plotted in GraphPad Prism 3.0 and fit to a one site competition curve using nonlinear regression to determine the equilibrium dissociation constants for the competitor aptamers ($K_i$). PDGF Homodimers: The structure of the PDGF homodimers of sequences 4149-8_379 (sequences 4149-8_438 through 4149-8_447) and 5169-4_26 (sequences 5169-4_134 through 5169-4_143) are shown in Table 15. For the 4149-8_379 based homodimers, the $K_i$ values obtained in the competition assay suggested that in the 5' to 3' configuration, a longer linker was desirable, since a greater than 10-fold improvement in binding affinity was measured with five Heg linkers compared to no Heg linker (0.25 pM vs 4.2 pM, respectively). In the 3' to 3' linked 4149-8_379 homodimers, the longer four and six Heg linkers also performed at least 10-fold better than no linker and approximately 2-fold better than the two Heg linkers. For the 5169-4_26 based homodimers, the $K_i$ values indicated a longer Heg linker was advantageous in the 5' to 3' configuration, since the $K_i$ improved from 28 pM for no Heg linker to 3.6 pM for six Heg linkers. There was no difference in the $K_i$ values for five and six Heg linkers in the 5' to 3' configuration. In the 3' to 3' linked 5169-4_26 based homodimers the same pattern was observed, with the $K_i$ improving as the Heg linker length increased. The six Heg linker showed a 5-fold improvement in the $K_i$ compared to no Heg linker (2.0 pM vs. 11 pM, respectively). In Tables 15 and 16, Z=Benzyl-deoxyuridine (Bn-dU), P=5-naphthalene modified dU (Nap-dU), M=methylenedioxybenzyl-dU (MBn-dU), a superscript 1 indicates a 2'-O-methyl modified nucleoside, no superscript indicates deoxyribonucleotides, "C3" indicates a three carbon linker and "H" indicates a hexaethylene glycol linker.

Example 11. PDGF/VEGF Heterodimer Aptamer Constructs

Heterodimers Based on PDGF Aptamer 4149-8 and VEGF Aptamer 4867-31.

With the aim of developing constructs with specificity for PDGF and VEGF, we designed and tested a variety of aptamer constructs comprising a VEGF aptamer linked to a PDGF aptamer. The first aptamer constructs tested combined PDGF variant 4149-8_273 and VEGF 4867-31_183. Aptamer constructs were synthesized head-to-tail, connected by zero to three hexaethylene glycol (Heg) linkers, in both orientations (either with the PDGF aptamer at the 5' end or VEGF aptamer at the 5' end). The results are shown in Table 17 and 18 below. In Table 17, "Z" denotes Bn-dU, "P" denotes Nap-dU, superscript "1" denotes 2'-O-methyl substitution, no superscript indicates deoxyribonucleotides, "V" denotes C3 spacer and "H" denotes hexaethylene glycol (Heg) linker. In Table 18, percent activity remaining denotes fractional PDGF βR phosphorylation levels in Hs27 fibroblasts in the presence of 20 nM aptamer relative to control (no aptamer).

Based on binding affinity for PDGF-BB, -AB, VEGF-121, and VEGF-165, aptamer construct 4149-8_320 appeared to give the best results in this experiment. We also tested the aptamer constructs in the PDGF cellular phosphorylation assay, as shown in Table 18. Based on the functional assay data, all aptamer constructs tested inhibited PDGF-BB-induced PDGF BR phosphorylation in Hs27 fibroblasts. Aptamer constructs 4149-8_313, 4149-8_314, 4149-8_315, 4149-8_316, 4149-8_319 and 4149-8_320 inhibited PDGF-BB-induced PDGF βR phosphorylation with $IC_{50}$ values of <20 nM. Aptamer constructs 4149-8_317 and 4149-8_318 had $IC_{50}$ values of ~20 nM.

We synthesized 4149-8_401, based on the configuration of 4149-8_320 (5'PDGF-3Heg-VEGF3'), comprising PDGF aptamer 4149-8_379 and VEGF aptamer 4867-31_192. See Table 19. In this table, "Z" denotes Bn-dU, "P" denotes Nap-dU, M denotes MBn-dU, superscript "1" denotes 2'-O-methyl substitution, no superscript denotes deoxyribonucleotides, "C3" denotes C3 spacer and "H" denotes hexaethylene glycol (Heg) linker. Aptamer construct 4149-8_401 showed binding affinity for PDGF-BB and VEGF121 that was equivalent or better than the binding affinity of its precursor aptamer construct, 4149-8_320. See Table 20.

Aptamer constructs 4149-8_320 and 4149-8_401 inhibited PDGF-BB-induced were PDGF-Rβ phosphorylation in Hs27 fibroblasts with $IC_{50}$ values of about 1 nM and 5 nM, respectively. Further, aptamer construct 4149-8_401 comprising a 5' amino linker conjugated to either 20 kDa or 40 kDa PEG maintained the ability to inhibit PDGF-BB-induced PDGF-Rβ phosphorylation in Hs27 fibroblasts with $IC_{50}$ values of about 1 nM. Those results are consistent with stoichiometric titration/inhibition of all of the PDGF in the assay (1 nM monomer).

We tested another set of aptamer constructs comprising aptamers 4149-8_379 and 4867-31_192 to determine the effect of overall linker length and the orientation of the PDGF and VEGF aptamers. See Table 21, below. With VEGF at the 5' end, we tested one to six Heg linkers. With PDGF at the 5' end, we tested two to six Heg linkers, including 4149-8_401, which has three Heg linkers. One Heg linker variant was not tested in this orientation because it exhibited somewhat reduced binding in a related variant 4149-8_318. Binding data are shown in Table 16. Most of the aptamer constructs performed well, with the exception of 4149-8_408 and 4149-8_409, which showed somewhat weaker affinity for PDGF-BB. The binding affinity of the Ophthotech aptamer E10030 (Fovista) is included for comparison.

Figure 18A:
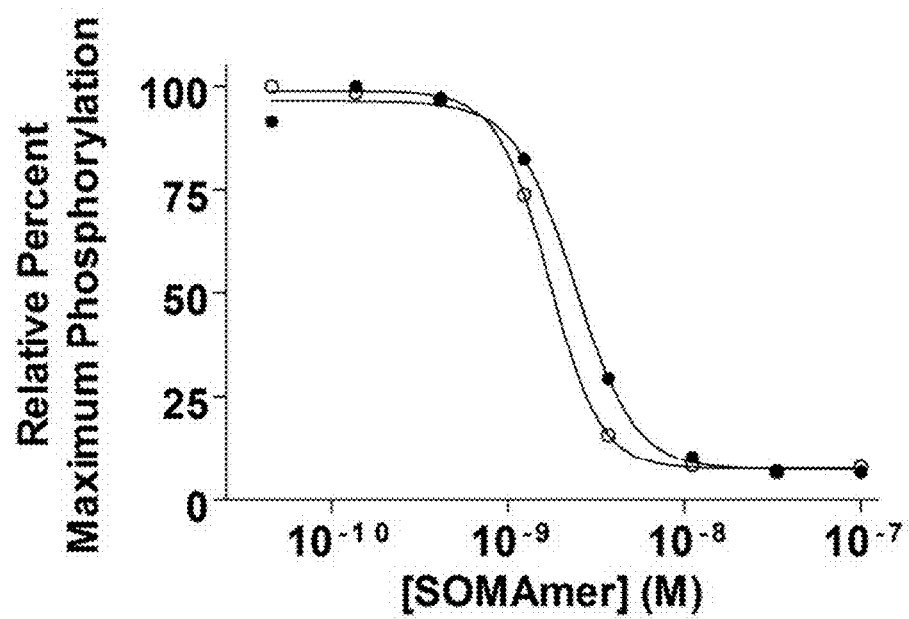
FIG. 18A shows inhibition of PDGF-induced PDGF Rβ phosphorylation in Hs27 fibroblasts with PDGF aptamer 4149-8_379 (open circles) and PDGF/VEGF aptamer construct 4149-8_401 (closed circles)
Figure 18B:
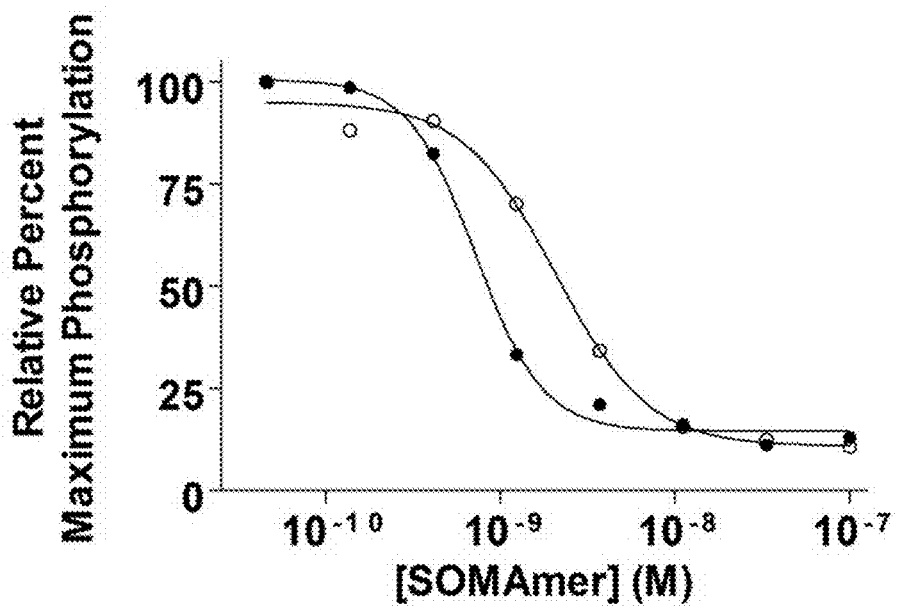
FIG. 18B shows inhibition of VEGF-induced VEGF R2 phosphorylation in HUVECs with VEGF aptamer 4867-31_192 (open circles) and PDGF/VEGF aptamer construct 4149-8_401 (closed circles); as described in Example 11.

The ability of the aptamer construct 4149-8_401 to inhibit the activity of both PDGF and VEGF in vitro was tested in the receptor phosphorylation experiments as described above. Aptamer construct 4149-8_401 inhibited PDGF-induced PDGFRβ phosphorylation in Hs27 fibroblasts with comparable potency to that of the PDGF monomer 4149-8_379 ($IC_{50}$ values of 2.4 nM and 1.7 nM, respectively). Similarly, aptamer construct 4149-8_401 inhibited VEGF-induced VEGFR2 phosphorylation in HUVEC cells with comparable potency to that of the VEGF monomer 4867-31_192 ($IC_{50}$ values of 0.7 nM and 2.1 nM, respectively). FIG. 18 shows the results of that experiment. FIG. 18A shows (A) inhibition of PDGF-induced PDGF Rβ phosphorylation in Hs27 fibroblasts with PDGF aptamer 4149-8_379 (open circles) and PDGF/VEGF aptamer construct 4149-8_401 (closed circles), and (B) inhibition of VEGF-induced VEGF R2 phosphorylation in HUVECs with VEGF aptamer 4867-31_192 (open circles) and PDGF/VEGF aptamer construct 4149-8_401 (closed circles).

Heterodimers Based on PDGF Aptamer 5169-4 and VEGF Aptamer 4867-31.

We have designed and tested additional heterodimer constructs based on the variants of PDGF aptamer 5169-4_26 and VEGF aptamer 4867-31_192. Aptamer constructs were synthesized head-to-tail, connected by one to six hexaethylene glycol (Heg) linkers, in both orientations (either with the PDGF aptamer at the 5' end or VEGF aptamer at the 5' end). The results are shown in Table 22. With VEGF at the 5' end Heg linkers between three and six resulted in the highest affinities. The affinities in general were slightly lower when the VEGF-121 aptamer sequence was on the 3' end, with most $K_d$ values falling in the 100-300 pM range, except for the five Heg linker sequence which had a $K_d$ of 56 pM. With PDGF at the 5' end, the $K_d$ values ranged from 11 pM for three Heg linkers to 0.54 pM for four Heg linkers, with the remaining $K_d$ values falling in between for all other Heg linker lengths. When PDGF was at the 3' end there was a trend towards higher binding affinity as the linker length increased, with one Heg linker having a $K_d$ of 5.3 pM and six Heg linkers having a $K_d$ of 0.20 pM. In Table 22, "P"

denotes Nap-dU, superscript "1" denotes 2'-O-methyl substitution, no superscript denotes deoxyribonucleotides and "H" denotes hexaethylene glycol (Heg) linker.

Example 12. Simultaneous Binding of PDGF/VEGF Aptamer Constructs to VEGF and PDGF To demonstrate the ability of the PDGF/VEGF aptamer constructs to bind VEGF and PDGF simultaneously, a sandwich assay was developed. Briefly, Nunc Maxisorp® plates were coated with either human PDGF-BB or human VEGF-121 (20 ng/mL). After blocking the wells with a 1% BSA solution, PDGF/VEGF aptamer construct was added (10 nM) and allowed to bind to the adsorbed protein target. After washing, the biotinylated complementary protein (2 nM PDGF-BB for VEGF-121 coated plates and 2 nM VEGF-121 or VEGF-165 for PDGF-BB coated plates) was allowed to bind to form a ternary complex. Following another wash, horseradish peroxidase conjugated streptavidin (HRP-SA) was added and allowed to form a quaternary complex. After a final wash, a color forming horse radish peroxidase substrate was added according to the manufacturer's directions (Thermo Scientific TMB substrate kit 34021) and the reaction stopped when appropriate by addition of 1.6 M $H_2SO_4$. The absorbance per well at 450 nm was determined with the Spectramax M5 plate reader with auto check on. In parallel to the method described above, a set of four control experiments were executed in which one of the 4 components that make up the quaternary complex was excluded.

Figure 19A:
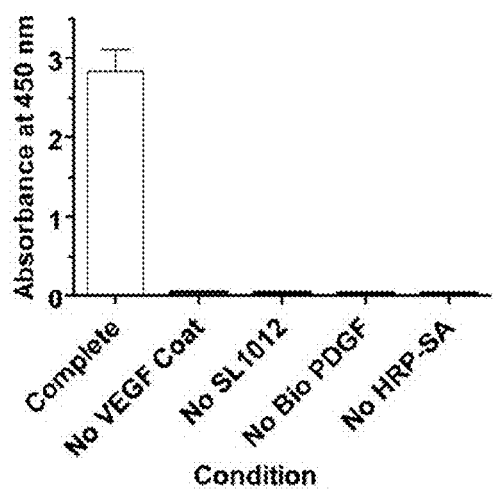
FIGS. 19A-B show simultaneous binding of PDGF and VEGF by PDGF/VEGF aptamer construct SL1012 (20 kDa PEG-N-4149-8_401) on microtiter plates coated with the VEGF with addition of biotinylated PDGF (FIG. 19A), and microtiter plates coated with PDGF with the addition of biotinylated VEGF (FIG. 19B), as described in Example 12.
Figure 19B:
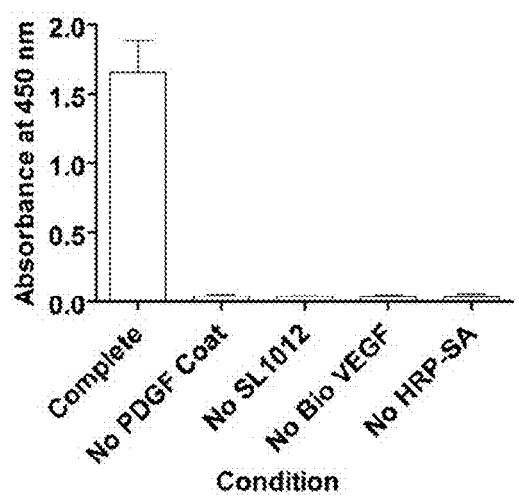

As shown in FIG. 19, PDGF/VEGF aptamer construct SL1012 (20 kDa PEG-N-4149-8_401) was able to bind simultaneously to human VEGF-121 and PDGF-BB. A strong signal was observed when all components of the quaternary complex were added (complete) while the absence of any one of the 4 components resulted in background or near background signal. Similar results were obtained with PDGF and VEGF coated plates, indicating that the order of protein addition to the aptamer construct did not matter. As shown in FIG. 19, SL1012 was able to bind simultaneously to human VEGF-165 and PDGF-BB. FIG. 19A shows microtiter plates coated with VEGF with addition of biotinylated PDGF. FIG. 19B shows microtiter plates coated with PDGF with addition of biotinylated VEGF. Data are presented as the mean+95% confidence interval (n=3). A strong signal was observed when all components of the quaternary complex were added (complete) while the exclusion of any of the four components resulted in background or near background signal. The data also demonstrate that the addition of a PEG moiety to the 5'-terminus of the aptamer construct does not preclude simultaneous binding activity.

Figure 20A:
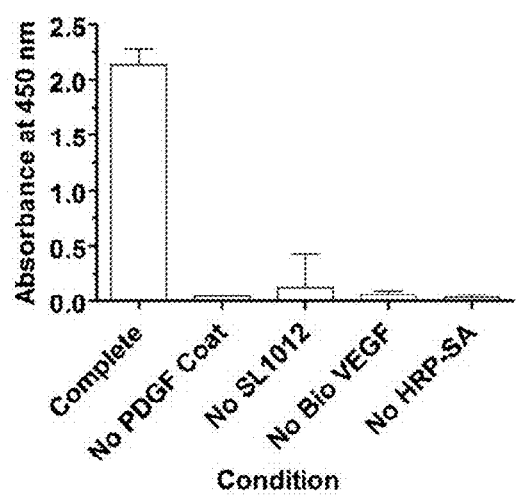
FIGS. 20A-B show simultaneous binding of PDGF and VEGF by PDGF/VEGF aptamer constructs SL1012 (20 kDa PEG-N-4149-8_401) (FIG. 20A) and SL1013 (40 kDA PEG-N-4149-8-401) (FIG. 20B), on microtiter plates that were coated with PDGF with the addition of biotinylated VEGF, as described in Example 12.
Figure 20B:
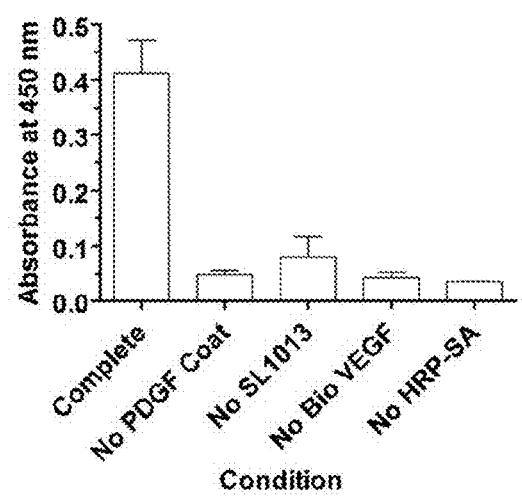

Simultaneous binding of human VEGF-165 and human PDGF-BB to (A) SL1012 or and (B) SL1013 (40 kDA PEG-N-4149-8-401) is shown in FIG. 20. Microtiter plates were coated with PDGF with addition of biotinylated VEGF. Complete means addition of all components of the quaternary complex, while each condition without one of the four components is shown in the graphs. Data are presented as the mean+95% confidence interval (n=3)

A similar experiment was performed with various aptamer constructs that did not contain the PEG moiety. In this experiment, only a no aptamer control was included because the previous results demonstrated the requirement for the other components of the complex to generate signal. As shown in FIG. 21, aptamer constructs 4149-8_317, 4149-

Figure 21A:
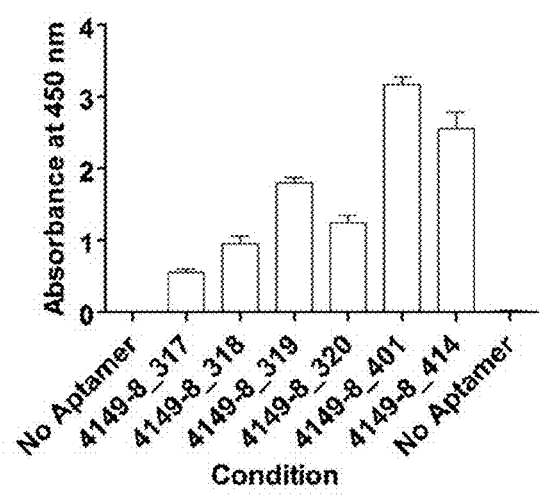
FIGS. 21A-B show the simultaneous binding of PDGF and VEGF by various PDGF/VEGF aptamer constructs on (FIG. 21A) microtiter plates coated with VEGF with the addition of biotinylated PDGF, and (FIG. 21B) microtiter plates coated with PDGF with the addition of biotinylated VEGF, as described in Example 12.
Figure 21B:
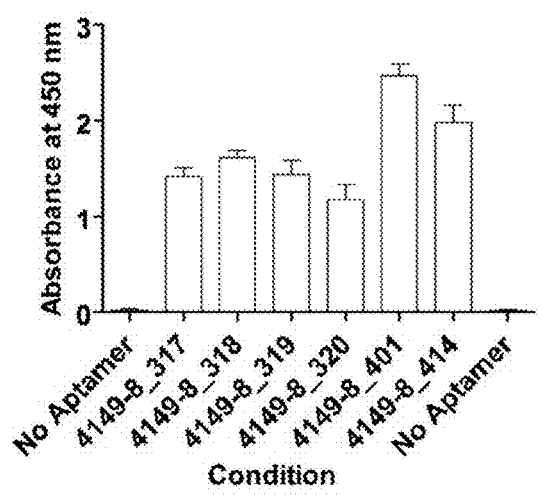

8_318, 4149-8_320, 4149-8_401 and 4149-8_414 simultaneously bound to PDGF and VEGF regardless of the order of protein addition. FIG. 21(A) shows microtiter plates coated with VEGF with addition of biotinylated PDGF and FIG. 21(B) shows microtiter plates coated with PDGF with addition of biotinylated PDGF.

Add data on simultaneous binding of heterodimer constructs based on the variants of PDGF aptamer 5169-4 and VEGF aptamer 4867-31.

Example 13. Intravitreal Pharmacokinetic Studies

Initial ocular pharmacokinetic testing was performed to understand how the aptamers and aptamer constructs behave in the eye. Four aptamers and aptamer constructs were tested as shown in Table 23.

For each aptamer or aptamer construct, a single intravitreal injection was performed into both eyes of five New Zealand White rabbits (10 eyes). Animals received either a 0.5 mg/eye dose (SL1010 and SL1011) or a 1.0 mg/eye dose (SL1012 and SL1013). These doses represent the weight of the aptamer or aptamer construct only (PEG weight was excluded from the calculations). All test articles were formulated in phosphate buffered saline. For each aptamer or aptamer construct test article, vitreous humor samples were collected from both eyes from one animal at 2, 24, 48, 96 or 192 hours post dose. Vitreous humor samples were stored frozen until they were assayed.

The vitreous humor concentrations of the aptamers or aptamer constructs were determined by ultra performance liquid chromatography (UPLC) assay methods with detection by absorbance at 260 nanometers (nm). Briefly, the vitreous hydrogel was sheered by passing it several times through a 20 gauge needle. Vitreous proteins were precipitated by the addition of 2 volumes of 2-ethoxyethanol. Following centrifugation, the supernatant was recovered and injected onto an Acquity® C18 column (0.2×100 mm). The column temperature was 80° C. and the flow rate was maintained at 0.2 mL/min. Buffer A consisted of TEAA pH 7.0 and 5% acetonitrile. Buffer B consisted of 100% acetonitrile. The program held 50% buffer B for 1 minute following the injection of sample and then buffer B was increased linearly to 70% over 4 minutes. Detection was accomplished by absorbance at 260 nm. Concentrations (free acid equivalent) of aptamer or aptamer construct in the vitreous humor were determined by interpolation of the peak absorbance units of the unknown samples to those obtained by a standard curve prepared with known concentrations of aptamer or aptamer construct.

The results of that experiment are shown in Table 24.

An ordinary linear regression fit of the natural logarithm of the vitreous concentration versus time resulted in estimates for the vitreous half-lives of 105, 47, 69 and 92 hours for SL1010, SL1011, SL1012, and SL1013, respectively. Table 25 shows the results, along with the 95% confidence interval.

These vitreous half-lives compare favorably to the half-lives in NZW rabbits of similar sized therapeutic VEGF inhibitors, such as Macugen (83 hours, Eyetech Study Group (2002) Retina 22:143) and Lucentis (70 hours, Gaudreault et al. (2007) Retina 27:1260). Therefore, these aptamers and aptamer constructs may be useful for the treatment of ocular diseases such as AMD and diabetic retinopathy.

Example 14. Materials and Methods

This Example provides a summary of the general methods and materials used in the proceeding examples.

Determination of Nuclease Sensitive Sites by Liquid Chromatography Coupled to Mass Spectrometry (LCMS):

For digestion by DNase I, polyacrylamide-gel-purified aptamer (500 nM final concentration) was incubated with recombinant human DNase I (Cell Sciences, Cat No. CSI10719) (0.3 units for 4149-8_379 and 3 units for 5169-4_146) in nuclease buffer (510 mM Tris HCl pH 7.6, 2.5 mM $MgCl_2$, 0.5 mM $CaCl_2$) at 37° C. in a total reaction volume of 150 µL. Aliquots (50 µL) were collected at 0, 30 and 60 minutes and the reaction terminated by incubating at 95° C. for 5 minutes. For digestion with DNase II 500 nM of gel purified aptamer was incubated with porcine DNase II (Worthington Biochemical Corporation) (18 units for 4867-31_192, 1 unit for 4149-8_379) in nuclease buffer (100 mM sodium acetate pH 4.6, 2 mM $MgCl_2$, 15 mM NaCl) at 37° C. in a total reaction volume of 150 µL. Aliquots were collected and the reactions stopped as described above. The 5'-amine containing versions of 4867-31_192 and 4149-8_379 and the 5'-OH version of 5169-4_146 were utilized for these experiments.

Following nuclease digestion, the full-length and aptamer fragments were separated by liquid chromatography and detected by ultraviolet absorbance and mass spectrometry (LCMS). Briefly, samples were analyzed on an LCMS system consisting of an Agilent 1100 HPLC equipped with a vacuum degasser (Model # G1322A), an autosampler (Model #G1313A), a binary pump module (Model # G1312A), a column manager with temperature control (Model #G1316A) and a variable wavelength detector (Model # G1314A)) coupled to a Bruker Esquire 3000 ion trap mass spectrometer. LCMS runs were performed with Agilent Chemstation® software (version B.01.03). The chromatography was performed using a Hamilton PRP-3, 2.1×150 mm column at 80° C. Mobile phase A contained 10 mM piperidine and 10 mM imidazole, pH approximately 10 (not adjusted); mobile phase B contained 10 mM piperidine and 10 mM imidazole in 75/25 acetonitrile/water. The flow rate was 0.25 mL/min and the gradient elution was 0-1 minutes: 0% B; 1-20 minutes:0-53% B. Samples (20 µL) were injected and absorbance determined at 254 nm. Typical source conditions for mass spectrometric detection were as follows: negative ion electrospray ionization mode, nebulizer pressure at 50 psi, drying gas at 7 L/min, source temperature was set at 325° C., and the capillary voltage was set at 3000 V. Trap conditions were scan range 200 to 2200 m/z, accumulation time 50 msec, trap drive 92, averaging 25 spectra.

Data were processed using Daltonics DataAnalysis® 2.0. Mass spectra were obtained by summing across the observed peak in the TIC, and smoothing using a Svitsky-Golay algorithm (smoothing width=0.8 m/z, cycles=2). Spectra were deconvoluted using the algorithm within the Daltonics software. Parameters included mass range between 2000-30000 Da, abundance cutoff of 10%, minimum peaks in component of 3, and molecular weight agreement of 0.05%.

DNase I Aptamer Stability Assay:

Polyacrylamide-gel-purified aptamers at a final concentration of 250 nM were incubated with 2 or 10 units/mL of recombinant human DNase I (Cell Sciences, Cat No. CSI10719) in nuclease buffer (10 mM Tris HCl pH 7.6, 2.5 mM $MgCl_2$, 0.5 mM $CaCl_2$) at 37° C. in a total reaction volume of 100 µL. At various times, a 20 µL aliquot was collected and the reaction stopped by adding an equal volume of 2× gel loading buffer (93.85% formamide, 0.03% SDS, 20 mM Na₂EDTA, 0.01% xylene cyanol and 0.01% Orange G) and heating at 95° C. for 2 minutes. Samples were loaded onto a 15% TBE polyacrylamide denaturing gel (8 M urea) and electrophoresis performed at 200 V for 20 minutes. Gels were stained with approximately 2 µM SYBR® Gold (Molecular Probes, Cat No. S11494) for 10 minutes to visualize the bands. The amount of full-length aptamer remaining at each time point was quantified using FlourChem®Q analysis software (Alpha Innotech). If necessary, the intensity of each band was determined following a background subtraction and data are presented as a percentage remaining of full-length input DNA at the zero time point. Aptamers with a hydroxyl at the 5'-terminus were utilized for these experiments except for aptamer 4149-8_379 which harbored a 5'-terminal amine.

DNase II Aptamer Stability Assay:

Polyacrylamide-gel-purified aptamers at a final concentration of 250 nM were incubated with 120 units/mL or 240 units/mL of porcine DNase II (Worthington Biochemical Corporation) in nuclease buffer (0.1M NaOAc pH 4.6, 2.0 mM MgCl₂, 15 mM NaCl₂) at 37° C. in a total reaction volume of 100 µL. At various times, a 20 µL aliquot was collected and the reaction stopped by adding an equal volume of 2× gel loading buffer (93.85% formamide, 0.03% SDS, 20 mM Na₂EDTA, 0.01% xylene cyanol and 0.01% Orange G) and heating at 95° C. for 2 minutes. Samples were loaded onto a 15% TBE polyacrylamide denaturing gel (8 M urea) and electrophoresis performed at 200 V for 20 minutes. Gels were stained with approximately 2 µM SYBR® Gold (Molecular Probes, Cat No. S11494) for 10 minutes to visualize the bands. The amount of full-length SOMAmer remaining at each time point was quantified using FlourChem® Q analysis software (Alpha Innotech). If necessary, the intensity of each band was determined following a background subtraction and data are presented as a percentage remaining of full-length input DNA at the zero time point. Aptamers with a hydroxyl at the 5'-terminus were utilized for these experiments except for aptamer 4149-8_379 which harbored a 5'-terminal amine.

SOMAmer Stability Assay in Rabbit Vitreous Humor:

Polyacrylamide-gel-purified aptamers at a final concentration of 500 nM were incubated in 90% pooled vitreous humor from New Zealand White rabbits (Bioreclamation IIC, Cat No. RAB-VITHUM. Samples were incubated at 37° C. in a total reaction volume of 200 µL (samples also contained a final concentration of 0.067% phosphate buffered saline). At various time points, a 20 µL aliquot was collected and the reaction stopped by adding an equal volume of 2× gel loading buffer (93.85% formamide, 0.03% SDS, 20 mM Na₂EDTA, 0.01% xylene cyanol and 0.01% Orange G). Samples were stored at −20° C. until processed. To each sample 100 µL of water was added followed by 150 µL of 25:24:1 Phenol/Chloroform/Isoamyl alcohol (AMRESCO). Samples were mixed and centrifuged at 16,100×g for 15 minutes. The aqueous phase was collected and frozen at −20° C. until gel analysis. Samples (15 µL) were loaded onto a 15% TBE polyacrylamide denaturing gel (8 M urea) and electrophoresis performed for approximately 20 minutes at 200 V. Gels were stained with approximately 2 µM SYBR® Gold (Molecular Probes, Cat No. S11494) for 10 minutes to visualize the bands. The amount of full-length SOMAmer remaining at each time point was quantified using FlourChem® Q analysis software (Alpha Innotech). If necessary, the intensity of each band was determined following a background subtraction and data presented as a percentage remaining of full-length input DNA at the zero time point.

Competition Binding Assay Methods:

Aptamers to be used as ligands in the competition binding assay were 5'-end-labeled using T4 polynucleotide kinase (New England Biolabs) and γ-[$^{32}$P]ATP (Perkin Elmer). The competition assay was performed by combining equal volumes of 2 nM ligand with unlabeled competitor (concentrations ranging from $10^{-6}$ to $10^{-11}$ M) in 1×SB18T buffer [40 mM Hepes (pH 7.5), 120 mM NaCl, 5 mM KCl, 5 mM MgCl₂, and 0.01% TWEEN-20]. Human PDGF-BB (Creative Biomart) at a concentration of 200 pM in 1×SB18T buffer was added to the ligand/competitor mixtures and the reactions were incubated at 37° C. for 40 minutes. Bound complexes were mixed with Zorbax® resin (Agilent Technologies) and captured on Durapore® filter plates. The signal in each well was quantified with a PhosphorImager (FUJI FLA-3000). Raw binding data were corrected for background signal and normalized to fraction bound for no competitor. To determine the inhibitor constants ($K_i$), the data were plotted in GraphPad Prism® 6 and fit to a one-site competition curve.

Example 15. VEGF Aptamers with Improved Nuclease Stability

Figure 23A:
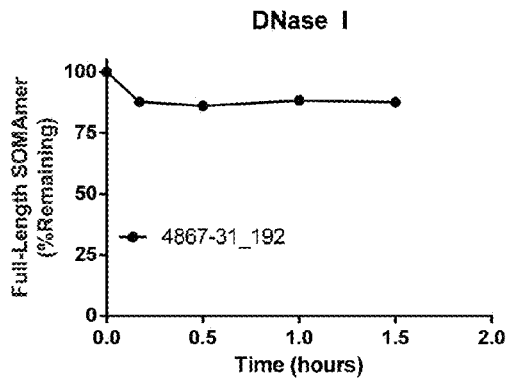
FIGS. 23A and B show plots of the percent of full-length aptamer 4867-31_192 (250 nM starting concentration) remaining versus time when digested at 37° C. for the indicated number of hours with 0.002 units/µL DNase I (FIG. 23A) or 0.24 units/µL DNase II (FIG. 23B) as described in Example 14. Digestion products were separated from full-length aptamer by polyacrylamide gel electrophoresis and bands visualized with SYBR Gold. Percent full-length aptamer band determined by desitometry.
Figure 23B:
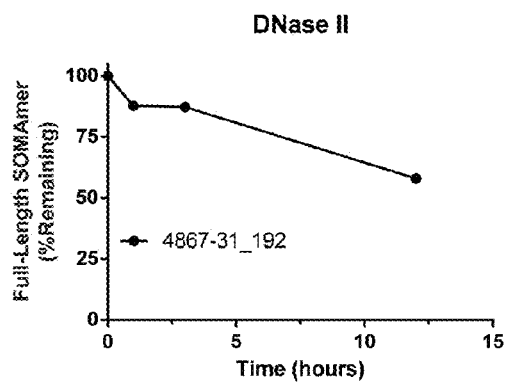

This Example provides the chemical modifications applied to VEGF aptamers that improve the nuclease stability of the aptamers. In this Example, the following abbreviations are used in context with the aptamer: P is NapdU and 2'-OMe is a 2'-O-methyl nucleotide. To enhance the nuclease resistance of the NapdU-containing Slow Off Rate Modified Aptamers (SOMAmers) selected to bind to human vascular endothelial growth factor (VEGF), 2'-O-methyl (2'-OMe) groups were added at nucleotide positions in which binding to VEGF protein was not significantly affected. These efforts led to the discovery of aptamer 4867-31_192 which contains nine 2'-OMe groups within the 29 nucleotide sequence. The use of Nap-dU nucleotides, the 2'-OMe substitutions and the addition of an inverted deoxythymidine at the 3'-terminus in 4867-31_192 together impart a substantial degree of nuclease protection compared with unmodified DNA Nevertheless, 4867-31_192 is still not fully stable in the presence of some nucleases. For example, while stable against human recombinant DNase I (FIG. 23A), 4867-31_192 is digested by porcine DNase II (FIG. 23B). As shown in FIG. 23B, a decrease in the amount of full-length aptamer over time indicates sensitivity to digestion by DNase II.

To determine the feasibility of further stabilizing the aptamer by using phosphorothioate linkages, a systematic substitution of phosphorothioates in place of individual phosphodiester bonds (the "phosphorothioate walk" experiment) was performed in order to determine which positions of aptamer 4867-31_192 could accept a phosphorothioate linkage without significantly impacting binding to VEGF121. For all sequences in this example and the proceeding examples, a nucleotide having a superscript "1" indicates that the nucleotide has a 2'-O-methyl modification, and a nucleotide having a superscript "2" indicates that the nucleotide has a 3'-phosphorothioate group and links that nucleotide to the nucleotide immediately 3' to it). A nucleotide having both superscript "1" and "2" indicates that the nucleotide has both a 2'-O-methyl modification and a 3'-phosphorothioate group and links that nucleotide to the nucleotide immediately 3' to it. All aptamers were tested for binding with the inclusion of an inverted deoxythymidine at the 3'-terminus. The results of this walk are shown in Table 26. Most, but not all, positions tested could accept a phosphorothioate linkage without severely impacting binding. An important exception was the guanine at position 3 (4867-31_410) where substitution of a phosphorothioate linkage for the natural phosphordiester linkage reduced affinity for VEGF121 by 29,259-fold.

Since nuclease sensitive sites cannot be predicted, the position(s) of the DNase II sensitive cleavage sites were identified by mass spectrometry following incubation with porcine DNase II as described in Example 14 (data not shown). For aptamer 4867-31_192 (with the addition of an inverted deoxythymidine at the 3'-terminus) two major fragments were identified. Fragment one contained nucleotides 1 through 24 while fragment two contained nucleotides 1 through 25. Therefore, a series of aptamers were created in which phosphorothioate linkages were substituted for phosphodiester linkages in various combinations between nucleotide positions 24 and 25, 25 and 26, and 26 and 27 as shown in Table 27. Substitutions at all 3 of these positions were allowed since none significantly affected binding (Table 26). Phosphorothioate substitutions were tested with or without the addition of a 2'-OMe cytosine at position 1 (Table 27). For nuclease stability experiments all subsequent aptamers were studied with the inclusion of an inverted deoxythymidine at the 3'-terminus.

Figure 24:
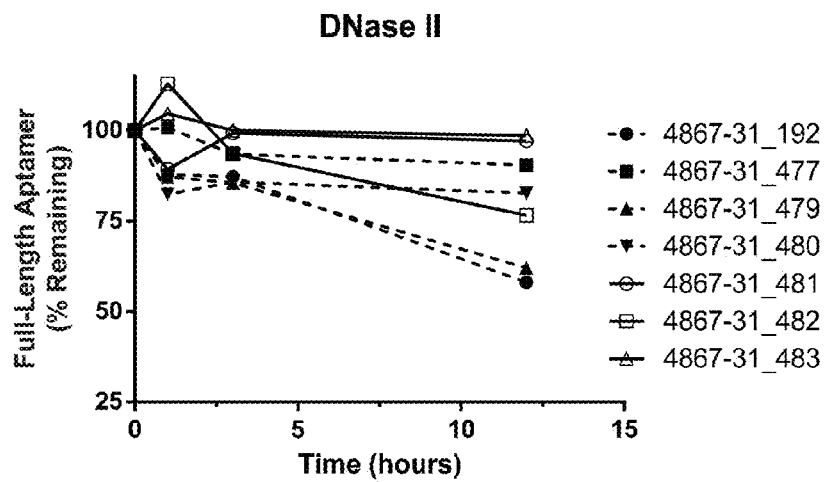
FIG. 24 shows plots of the percent full-length aptamer remaining (250 nM starting concentration) versus time when incubated at 37° C. for the indicated number of hours with 0.24 units/µL DNase II as described in Example 14. Digestion products were separated from full-length aptamer by polyacrylamide gel electrophoresis and bands visualized with SYBR Gold. Percent full-length aptamer remaining, as indicated by aptamer identification no. was determined by desitometry. The plot for aptamer ID no. 4867-31_192 is the same plot as shown in FIG. 23B.

The susceptibility to DNase II was examined as described in Example 14 and the data presented in FIG. 24. All aptamers tested that had phosphorothioate linkages between positions 24 and 25 and 25 and 26 were more stable in this assay than aptamers that were not modified at these two positions. This trend was observed for aptamers with or without a 2'-OMe at position 1.

Figure 25:
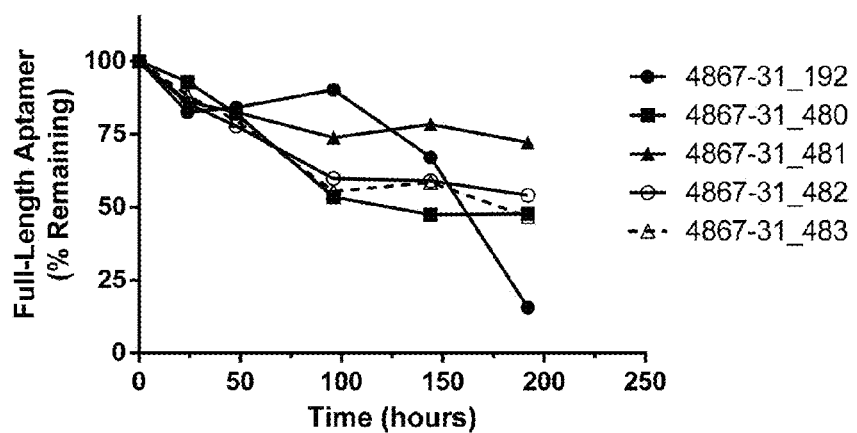
FIG. 25 shows plots of the percent full-length aptamer remaining (500 nM starting concentration) versus time when incubated at 37° C. for the indicated number of hours in 90% vitreous humor obtained from New Zealand White rabbits as described in Example 14. (Aptamers were resolved by polyacrylamide gel electrophoresis and stained with SYBR Gold. Percent full-length aptamer remaining, as indicated by aptamer identification no. was determined by desitometry.

The aptamer 4867-31_192 and a subset of aptamers with phosphorothioate linkages at both key positions were next tested for stability in 90% rabbit vitreous humor (FIG. 25). Because we are considering developing aptamers-based antagonists to VEGF and PDGF for the treatment of ocular disorder, stability in the vitreous humor has relevance for their therapeutic effectiveness. As illustrated in the plot of percent full-length aptamers remaining versus incubation time (FIG. 25), all of the aptamers modified with phosphorothioate linkages were more stable (at 192 hours) in this biological matrix than 4867-31_192 (without phosphorothioate linkages).

To ensure these substitutions did not adversely affect binding, an experiment was performed to test each aptamer for binding to human VEGF121 protein. All sequences tested retained high affinity binding to target. The dissociation constants ($K_d$ values) obtained in this experiment are shown in Table 27.

FIG. 24 shows the percentage of full-length aptamer remaining versus incubation time with DNase II as described in Example 14. Aptamers (all at 250 nM), as indicated by aptamer identification no. (Aptamer ID No.), were incubated at 37° C. for the indicated number of hours with 0.24 units/µL DNase II and the digestion products separated by polyacrylamide gel electrophoresis. As determined by densitometry, the percentage of full-length aptamer remaining versus incubation time is plotted. The plot for aptamer ID no. 4867-31_192 in FIG. 24 is the same plot as shown in FIG. 23B.

FIG. 25 shows the percentage of full-length aptamer remaining versus incubation time in vitreous humor as described in Example 14. Aptamers (all at 500 nM) as indicated by aptamer identification no. (Aptamer ID No.) were incubated at 37° C. for the indicated number of hours in 90% vitreous humor obtained from New Zealand White rabbits. Aptamers were resolved by polyacrylamide gel electrophoresis. FIG. 25 shows the percent remaining of each full-length aptamer band versus time as determined by densitometry.

In summary, these data, generally, indicate that the 4867-31 aptamer with phosphorothioate linkage(s) is less sensitive to nuclease digestion than the 4867-31 aptamer without phosphorothioate linkage(s), and further, that the 4867-31 aptamer with phosphorothioate linkage(s) retains binding affinity to the VEGF protein target.

Example 16. PDGF Aptamers with Improved Nuclease Stability

This Example provides the chemical modifications applied to PDGF aptamers (e.g., 5169-4) that improve the nuclease stability of the aptamers. In this Example, the following abbreviations are used in context with the aptamer: P is NapdU and 2'-OMe is a 2'-O-methyl nucleotide.

Figure 26A:
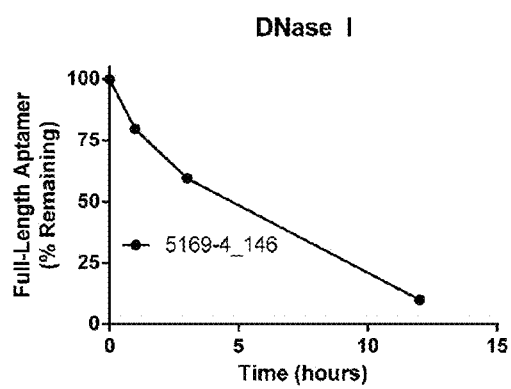
FIGS. 26A and B show plots of the percent of full-length aptamer 5169-4_146 (250 nM starting concentration) remaining versus time when digested at 37° C. for the indicated number of hours with 0.01 units/µL DNase I (FIG. 25A) or 0.12 units/µL DNase II (FIG. 26B) as described in Example 14. Digestion products were separated from full-length aptamer by polyacrylamide gel electrophoresis and bands visualized with SYBR Gold. Percent full-length aptamer was determined by desitometry.

To enhance the nuclease resistance of the NapdU-containing Slow Off Rate Modified Aptamers (SOMAmers) selected to bind to human platelet derived growth factor (PDGFBB), 2'-O-methyl groups (2'-OMe) were added at nucleotide positions in which binding to PDGF protein was not or only minimally affected. These efforts led to the discovery of aptamer 5169-4_146 which contains eleven 2'-OMe groups within the 21 nucleotide sequence. With these eleven 2'-OMe modifications and an inverted deoxythymidine at the 3'-terminus, 5169-4_146 is stable against DNase II, but not against DNAse I (FIG. 26). Therefore, in contrast to the VEGF aptamers 4867-31_192 described in Example 15 which was more sensitive to DNase II than DNase I, PDGF-BB aptamers 5169-4_146 exhibits greater sensitivity to DNase I compared with DNase II. In other words, the sensitivity of 5169-4_146 to DNase I, but not DNase II is opposite to the result found in Example 15 and shows the unpredictability of aptamers sensitivity to nucleases. This suggests that the intrinsic sensitivity to degradation by specific nucleases cannot be predicted and has to be determined empirically. Once this sensitivity to a specific nuclease is determined, additional stability might be achieved with additional phophorothioate substitutions at the remaining sensitive positions. As shown in FIG. 26A, a decrease in full-length aptamer over time indicates sensitivity to digestion by DNase I.

Figure 26B:
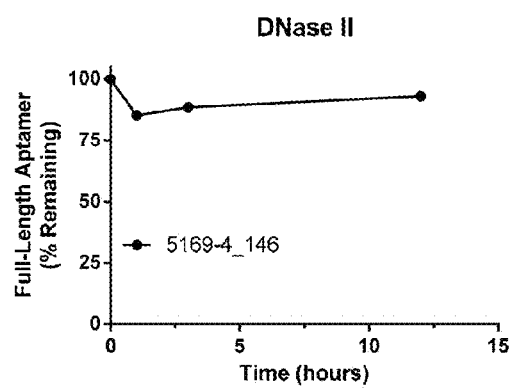

As shown in FIG. 26, aptamer 5169-4_146 (250 nM) was incubated at 37° C. for the indicated number of hours with 0.01 units/p L DNase I (FIG. 26A) or 0.12 units/µL DNase II (FIG. 26B) as described in Example 14 and the digestion products separated by polyacrylamide gel electrophoresis. As determined by densitometry, the percentage of full-length aptamer remaining versus incubation time is plotted.

To determine the feasibility of further stabilizing the aptamer by using phosphorothioate linkages, a "phosphorothioate walk" experiment was performed on 5169-4_146 in order to determine which positions could accept a phosphorothioate without significantly impacting aptamer binding to PDGF. The results of this walk are shown in Table 28. All aptamers tested included an inverted deoxythymidine at the 3' terminus. Phosphorothioate substitution was well-tolerated at all positions of the 5169-4_146 sequence. The maximum impairment of binding to PDGF was a reduction of affinity by 1.8-fold (5169-4_154).

Similar to Example 15, the position of the sensitive nucleotides of 5169-4_146 (with an inverted deoxythymidine at the 3' terminus) to cleavage by DNase I were identified by mass spectrometry and these most sensitive "nuclease sites" protected by substitution of a 3'-phosphorothioate linkage in place of the natural 3'-phosphodiester linkage.

Figure 27:
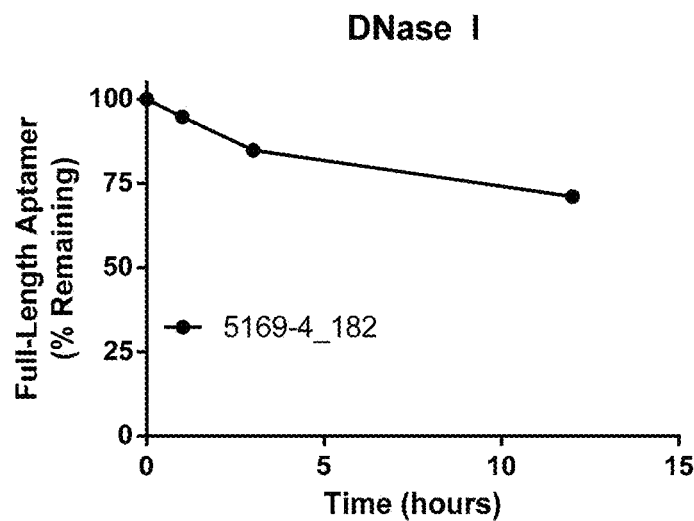
FIG. 27 shows a plot of the percent full-length aptamer 5169-4_182 remaining (250 nM starting concentration) versus time when incubated at 37° C. for the indicated number of hours with 0.01 units/p L DNase I as described in Example 14. Digestion products were separated from full-length aptamer by polyacrylamide gel electrophoresis and bands visualized with SYBR Gold. Percent full-length aptamer determined by desitometry.

For aptamer 5169-4_146 several fragments were identified following digestion with human recombinant DNase I. These fragments revealed DNase I sensitive sites between nucleotide position 9 and 10; 10 and 11; 11 and 12; and 12 and 13. Therefore an aptamer was created in which phosphorothioate linkages were substituted for phosphodiester at these four positions and designated as aptamer 5169-4_182 (Table 29). These aptamers were tested for nuclease resistance with the inclusion of an inverted deoxythymidine at the 3' terminus. The susceptibility to DNase I was examined as before (FIG. 27). The phosphorothioate-containing aptamer was clearly more stable than 5169-4_146.

As shown in FIG. 27, aptamer 5169-4_182 (250 nM) was incubated at 37° C. for the indicated number of hours with 0.01 units/μL DNase I as described in example 14 and the digestion products separated by polyacrylamide gel electrophoresis. Bands were visualized with SYBR gold and, as determined by densitometry, the percentage of full-length aptamer remaining versus incubation time is plotted.

Figure 28:
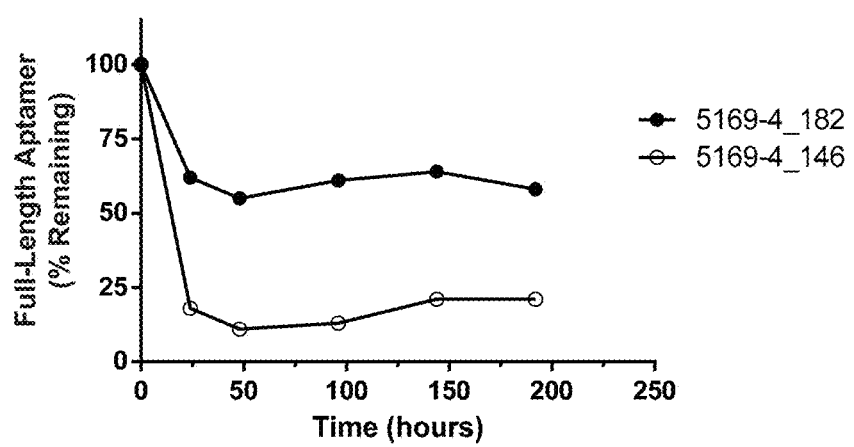
FIG. 28 shows plots of the percent of full-length aptamer remaining (500 nM starting concentration) versus time when incubated at 37° C. for the indicated number of hours in 90% vitreous humor obtained from New Zealand White rabbits as described in Example 14. Digestion products were separated from full-length aptamer by polyacrylamide gel electrophoresis and bands visualized with SYBR Gold. Percent full-length aptamer, as indicated by aptamer identification no. was determined by desitometry.

The same aptamer was also tested for stability in 90% rabbit vitreous humor (FIG. 28). As illustrated in the plot of percent full-length aptamers remaining versus incubation time (FIG. 28), aptamer 5169-4_182 (with phosphorothioate linkages) was more stable in this biological matrix than 5169-4_146 (without phosphorothioate linkages).

As shown in FIG. 28, aptamers (at 500 nM) as indicated were incubated at 37° C. for the indicated number of hours in 90% vitreous humor obtained from New Zealand white rabbits as described in Example 14. Aptamers were visualized by polyacrylamide gel electrophoresis. FIG. 28 shows the percent remaining of each full length aptamer band (SOMAmer) versus time as determined by densitometry.

Figure 29:
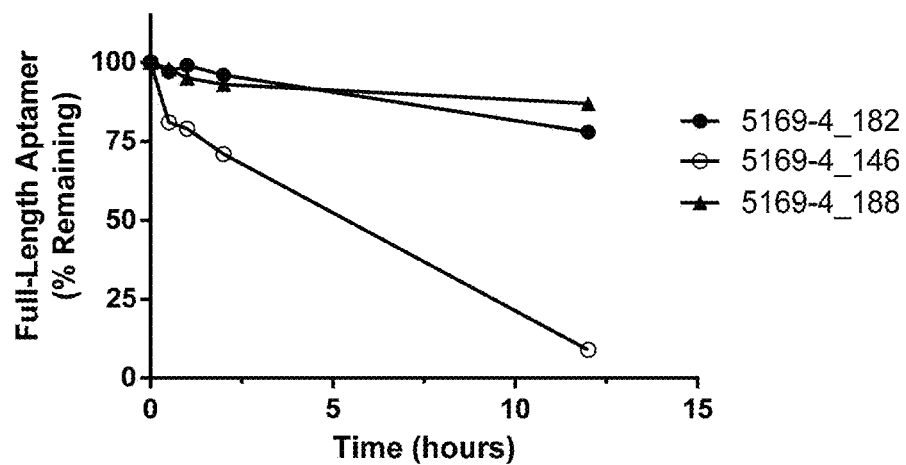
FIG. 29 shows plots of the percent full-length aptamer remaining (250 nM starting concentration) versus time when incubated at 37° C. for the indicated number of hours with 0.01 units/µL DNase I as described in Example 14. Digestion products were separated from full-length aptamer by polyacrylamide gel electrophoresis and bands visualized with SYBR Gold. Percent full-length aptamer remaining, as indicated by aptamer identification no. was determined by desitometry.

Although 5169-4_182 was clearly more stable than 5169-4_146, a DNase I digestion product of 5169-4_182 was clearly visible (data not shown). Using the mass spectrometry described in Example 14, the cleavage site for this major digestion product was identified as between nucleotide positions 4 and 5. This was surprising as nucleotide position 4 was already protected by a 2'-OMe moiety (Table 29). This result illustrates the fact that there are nucleases capable of cleaving phosphodiester bonds adjacent to 2'-OMe-substituted nucleotides. Nonetheless, a 3'-phosphorothioate linkage was substituted for the natural phosphodiester linkage between nucleotide positions 4 and 5 of 5169-4_182 to create aptamer 5169-4_188 (Table 29). The susceptibility to DNase I was examined as before (FIG. 29). Aptamers 5169-4_182 and 5169-4_188 were more stable than 5169-4_146. The addition of a phosphorothioate linkage between nucleotides 4 and 5 in 5169-4_188 eliminated the appearance of the stable digestion product observed for 5169-4_182 (data not shown) which led to a better stability against DNase I (FIG. 29).

As shown in FIG. 29, aptamers, as indicated by aptamer identification no. (Aptamer ID No.), were incubated at 37° C. for the indicated number of hours with 0.01 units/μL DNase I as described in example 14 and the digestion products separated by polyacrylamide gel electrophoresis. Bands were visualized with SYBR gold and, as determined by densitometry, the percentage of full-length aptamer remaining versus incubation time is plotted.

To ensure these substitutions did not adversely affect binding, an experiment was performed to determine the affinity of each aptamers for human PDGFBB protein. All sequences tested retained high affinity binding to target. The dissociation constants ($K_d$ values) obtained in this experiment are shown in Table 29.

In summary, these data, generally, indicate that the 5169-4 aptamer with phosphorothioate linkage(s) are less sensitive to nuclease digestion than the 5169-4 aptamer without phosphorothioate linkage(s), and further, that the 5169-4 aptamer with phosphorothioate linkage(s) retains binding affinity to the PDGF protein target.

Example 17. Additional PDGF Aptamers with Improved Nuclease Stability

This Example provides the chemical modifications applied to PDGF aptamers (e.g., 4149-8) that improve the nuclease stability of the aptamers. In this Example, the following abbreviations are used in context with the aptamer: P is a NapdU; 2'-OMe is a 2'-O-methyl nucleotide; Bn is a BenzyldU (BndU); M is a methoxybenzyl (MBndU); V is a 3 carbon spacer; and i is iBudU.

Figure 30:
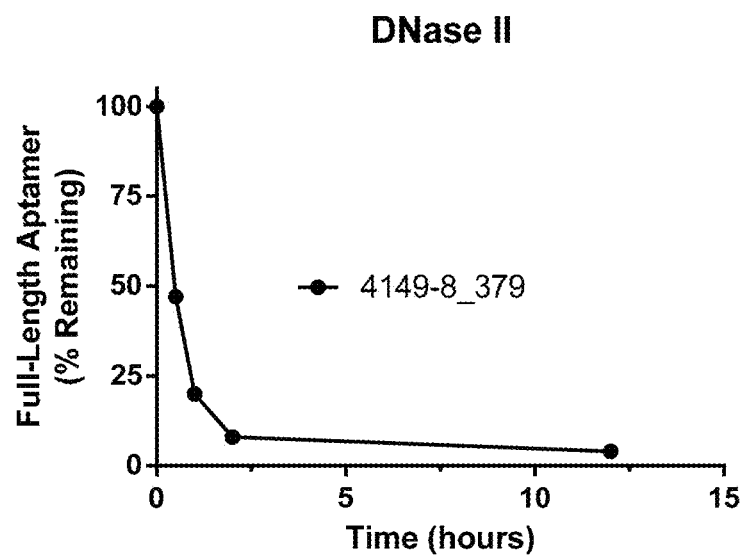
FIG. 30 shows a plot of the percent full-length aptamer 4149-8_379 remaining (250 nM starting concentration) versus time when incubated at 37° C. for the indicated number of hours with 0.12 units/µL DNase II as described in Example 14. Digestion products were separated from full-length aptamer by polyacrylamide gel electrophoresis and bands visualized with SYBR Gold. Percent full-length aptamer determined by desitometry.

To enhance the nuclease resistance of the BndU-containing Slow Off Rate Modified Aptamers (SOMAmers) selected to bind to human platelet derived growth factor (PDGFBB), 2'-O-methyl (2'-OMe) groups were added at nucleotide positions in which binding to PDGF protein was not significantly affected. These efforts led to the discovery of aptamer 4149-8_379 which contains seven 2'-OMe groups within the 24 nucleotide sequence. Even with these seven 2'-OMe modifications, 4149-8_379 is still not impervious to nuclease digestion. For example, 4149-8_379 can be digested with recombinant human DNase I (data not shown) and porcine DNase II (FIG. 30). As shown in FIG. 30, a decrease of the full-length aptamer over time indicates sensitivity to digestion by DNase II. This sensitivity to both DNase I and DNase II for 4149-8_379 is different than found for examples 15 and 16 and again shows the unpredictability of the nuclease stability of aptamers.

As shown in FIG. 30, aptamer 4149-8_379 (250 nM) was incubated at 37° C. for the indicated number of hours with 0.12 units/p L DNase II as described in Example 14 and the digestion products separated by polyacrylamide gel electrophoresis. Bands were visualized with SYBR Gold and, as determined by densitometry, the percentage of full-length aptamer remaining versus incubation time is plotted.

In order to further enhance the nuclease resistance of this aptamer, the position of the sensitive nucleotides to the action of DNase I and DNase II were identified by mass spectrometry by the method described in Example 14. DNase I sensitive sites were identified between nucleotide positions 15 and 16 and between nucleotide positions 16 and 17. A DNase II sensitive site was identified between nucleotide positions 9 and 10. Therefore phosphorothioate linkages were substituted for the phosphodiester linkages at these three positions. In addition, a phosphorothioate linkage was substituted for the phosphodiester linkage between nucleotides 17 and 18. Finally the 3, 4 methylene dioxy benzyl-dU nucleotide (or MBndU; designated by M in Tables 30 and 31) at position 2 replaced with a BndU and the BndU at position 16 replaced with a NapdU. This aptamer was designated 4149-8_454 (Table 30). Aptamer 4149-8_455 was created which, in addition to the modifications of 4149-8_454, also contained a 2'-OMe G as position 13 and a phosphorothioate linkage in place of the natural phosphodiester linkage between nucleotides 8 and 9 (Table 30).

Although a complete phosphorothioate walk was not performed, a number of sequences were created and tested for affinity to PDGFBB (Table 31). Some of these sequences served as a guide for creating the aptamers are shown in Table 31.

The susceptibility to DNase II was examined as before (FIG. 31) when all aptamers contained an inverted deoxythymidine at the 3' terminus. The results show that aptamer 4149-8_455 was more stable than 4149-8_454 which was more stable than 4149-8_379.

Aptamers 4149-8_379 and 4149-8_454 with the addition of an inverted deoxythymidine at the 3'-terminus were tested for stability in 90% rabbit vitreous humor (data not shown). However, in this biological matrix no additional stability was obtained with 4149-8_454 as compared to 4149-8_379.

To ensure these substitutions did not adversely affect binding, an experiment was performed to determine the affinity of each aptamer for human PDGFBB protein. All sequences tested retained their binding affinity to the target. The dissociation constants ($K_d$ values) obtained in this experiment are shown in Table 30.

Figure 31:
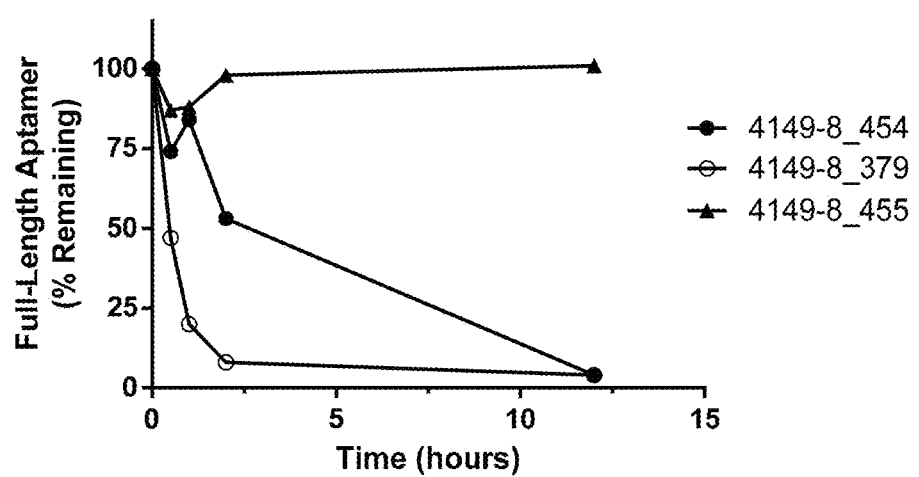
FIG. 31 shows plots of the percent full-length aptamer remaining (250 nM starting concentration) versus time when incubated at 37° C. for the indicated number of hours with 0.12 units/µL DNase II as described in Example 14. Digestion products were separated from full-length aptamer by polyacrylamide gel electrophoresis and bands visualized with SYBR Gold. Percent full-length aptamer, as indicated by aptamer identification no. was determined by desitometry. The plot for aptamer ID no. 4149-8_379 is the same plot as shown in FIG. 30.

As shown in FIG. 31, the aptamers as indicated by aptamer ID no. (i.e., 4149-8_379; 4149-8_454 and 4149-8_455) were incubated at 37° C. for the indicated number of hours with DNase II and the digestion products separated by polyacrylamide gel electrophoresis. As The percent full-length aptamer, as determined by densitrometry from the gel image, versus incubation time is plotted. The plot for aptamer ID no. 4149-8_379 in FIG. 31 is the same plot as shown in FIG. 30.

The foregoing embodiments and examples are intended only as examples. No particular embodiment, example, or element of a particular embodiment or example is to be construed as a critical, required, or essential element or feature of any of the claims. Various alterations, modifications, substitutions, and other variations can be made to the disclosed embodiments without departing from the scope of the present invention, which is defined by the appended claims. The specification, including the figures and examples, is to be regarded in an illustrative manner, rather than a restrictive one, and all such modifications and substitutions are intended to be included within the scope of the invention. Accordingly, the scope of the invention should be determined by the appended claims and their legal equivalents, rather than by the examples given above. For example, steps recited in any of the method or process claims may be executed in any feasible order and are not limited to an order presented in any of the embodiments, the examples, or the claims.

TABLE 1

Sequences Representative of the 4149-8_1 and Truncated Variants with $K_d$ values for PDGF of 10 nM or less

| Aptamer ID. No. | Sequence (5'→ 3') | SEQ ID NO. |
|---|---|---|
| 4149-8_1 | C-G-C-C-T-C-G-T-C-C-C-A-T-C-T-C-Bn-Bn-A-C-G-A-C-Bn-A-C-G-Bn-Bn-A-C-A-C-G-C-G-Bn-Bn-A-Bn-A-G-C-G-Bn-C-A-A-C-C-C-G-A-G-Bn-G-A-A-C-A-C-C-A-A-C-C-G-A-G-A-A-C-G | 1 |
| 4149-8_2 | A-T-C-T-C-Bn-Bn-A-C-G-A-C-Bn-A-C-G-Bn-Bn-A-C-A-C-G-C-G-Bn-Bn-Bn-A-Bn-A-G-C-G-Bn-C-A-A-C-C-C-G-A-G-Bn-G-A-A-C-A | 2 |
| 4149-8_4 | A-T-C-T-C-Bn-Bn-A-C-G-A-C-Bn-A-C-G-Bn-Bn-A-C-A-C-G-C-G-Bn-Bn-Bn-A-Bn-A-G-C-G-Bn-C-A-A-C-C-C-G-A-G-Bn-G-A-A | 3 |
| 4149-8_5 | A-T-C-T-C-Bn-Bn-A-C-G-A-C-Bn-A-C-G-Bn-Bn-A-C-A-C-G-C-G-Bn-Bn-Bn-A-Bn-A-G-C-G-Bn-C-A-A-C-C-C-G-A-G-Bn-G | 4 |
| 4149-8_6 | A-T-C-T-C-Bn-Bn-A-C-G-A-C-Bn-A-C-G-Bn-Bn-A-C-A-C-G-C-G-Bn-Bn-Bn-A-Bn-A-G-C-G-Bn-C-A-A-C-C-C-G-A-G | 5 |
| 4149-8_7 | A-T-C-T-C-Bn-Bn-A-C-G-A-C-Bn-A-C-G-Bn-Bn-A-C-A-C-G-C-G-Bn-Bn-Bn-A-Bn-A-G-C-G-Bn-C-A-A-C-C-C-G | 6 |
| 4149-8_8 | A-T-C-T-C-Bn-Bn-A-C-G-A-C-Bn-A-C-G-Bn-Bn-A-C-A-C-G-C-G-Bn-Bn-Bn-A-Bn-A-G-C-G-Bn-C-A-A-C-C | 7 |
| 4149-8_9 | A-T-C-T-C-Bn-Bn-A-C-G-A-C-Bn-A-C-G-Bn-Bn-A-C-A-C-G-C-G-Bn-Bn-Bn-A-Bn-A-G-C-G-Bn-C-A-A | 8 |
| 4149-8_10 | A-T-C-T-C-Bn-Bn-A-C-G-A-C-Bn-A-C-G-Bn-Bn-A-C-A-C-G-C-G-Bn-Bn-Bn-A-Bn-A-G-C-G-Bn-C | 9 |
| 4149-8_11 | C-T-C-Bn-Bn-A-C-G-A-C-Bn-A-C-G-Bn-Bn-A-C-A-C-G-C-G-Bn-Bn-Bn-A-Bn-A-G-C-G-Bn-C-A-A-C-C-C-G-A-G-Bn-G-A-A-C-A | 10 |
| 4149-8_12 | C-Bn-Bn-A-C-G-A-C-Bn-A-C-G-Bn-Bn-A-C-A-C-G-C-G-Bn-Bn-Bn-A-Bn-A-G-C-G-Bn-C-A-A-C-C-C-G-A-G-Bn-G-A-A-C-A | 11 |
| 4149-8_13 | Bn-A-C-G-A-C-Bn-A-C-G-Bn-Bn-A-C-A-C-G-C-G-Bn-Bn-Bn-A-Bn-A-G-C-G-Bn-C-A-A-C-C-C-G-A-G-Bn-G-A-A-C-A | 12 |
| 4149-8_20 | C-Bn-Bn-A-C-G-A-C-Bn-A-C-G-Bn-Bn-A-C-A-C-G-C-G-Bn-Bn-Bn-A-Bn-A-G-C-G-Bn-C-A-A-C-C-C-G-A-G-Bn-G-A-A-C | 13 |
| 4149-8_21 | C-Bn-Bn-A-C-G-A-C-Bn-A-C-G-Bn-Bn-A-C-A-C-G-C-G-Bn-Bn-Bn-A-Bn-A-G-C-G-Bn-C-A-A-C-C-C-G-A-G-Bn-G-A-A | 14 |

TABLE 1-continued

Sequences Representative of the 4149-8_1 and Truncated Variants with $K_d$ values for PDGF of 10 nM or less

| Aptamer ID. No. | Sequence (5'→ 3') | SEQ ID NO. |
| --- | --- | --- |
| 4149-8_22 | C-Bn-Bn-A-C-G-A-C-Bn-A-C-G-Bn-Bn-A-C-A-C-G-C-G-Bn-Bn-Bn-A-Bn-A-G-C-G-Bn-C-A-A-C-C-C-G-A-G-Bn-G-A | 15 |
| 4149-8_23 | C-Bn-Bn-A-C-G-A-C-Bn-A-C-G-Bn-Bn-A-C-A-C-G-C-G-Bn-Bn-Bn-A-Bn-A-G-C-G-Bn-C-A-A-C-C-C-G-A-G-Bn-G | 16 |
| 4149-8_24 | C-Bn-Bn-A-C-G-A-C-Bn-A-C-G-Bn-Bn-A-C-A-C-G-C-G-Bn-Bn-Bn-A-Bn-A-G-C-G-Bn-C-A-A-C-C-C-G-A-T | 17 |
| 4149-8_25 | C-Bn-Bn-A-C-G-A-C-Bn-A-C-G-Bn-Bn-A-C-A-C-G-C-G-Bn-Bn-Bn-A-Bn-A-G-C-G-Bn-C-A-A-C-C-C-G-A-G | 18 |
| 4149-8_26 | C-Bn-Bn-A-C-G-A-C-Bn-A-C-G-Bn-Bn-A-C-A-C-G-C-G-Bn-Bn-Bn-A-Bn-A-G-C-G-Bn-C-A-A-C-C-C-G-A | 19 |
| 4149-8_27 | C-T-C-Bn-Bn-A-C-G-A-C-Bn-A-C-G-Bn-Bn-A-C-A-C-G-C-G-Bn-Bn-Bn-A-Bn-A-G-C-G-Bn-C | 20 |
| 4149-8_28 | C-Bn-Bn-A-C-G-A-C-Bn-A-C-G-Bn-Bn-A-C-A-C-G-C-G-Bn-Bn-Bn-A-Bn-A-G-C-G-Bn-C | 21 |
| 4149-8_29 | C-Bn-Bn-A-C-G-A-C-Bn-A-C-G-Bn-Bn-A-C-A-C-G-C-G-Bn-Bn-Bn-A-Bn-A-G-C-G-T | 22 |
| 4149-8_30 | C-Bn-Bn-A-C-G-A-C-Bn-A-C-G-Bn-Bn-A-C-A-C-G-C-G-Bn-Bn-Bn-A-Bn-A-G-C-G | 23 |
| 4149-8_31 | C-Bn-Bn-A-C-G-A-C-Bn-A-C-G-Bn-Bn-A-C-A-C-G-C-G-Bn-Bn-Bn-A-Bn-A-G-C | 24 |
| 4149-8_32 | C-Bn-Bn-A-C-G-A-C-Bn-A-C-G-Bn-Bn-A-C-A-C-G-C-G-Bn-Bn-Bn-A-Bn-A-G | 25 |
| 4149-8_36 | Bn-Bn-A-C-G-A-C-Bn-A-C-G-Bn-Bn-A-C-A-C-G-C-G-Bn-Bn-Bn-A-Bn-A-G-C-G-Bn-C | 26 |
| 4149-8_37 | Bn-Bn-A-C-G-A-C-Bn-A-C-G-Bn-Bn-A-C-A-C-G-C-G-Bn-Bn-Bn-A-Bn-A-G-C-G-T | 27 |
| 4149-8_38 | Bn-Bn-A-C-G-A-C-Bn-A-C-G-Bn-Bn-A-C-A-C-G-C-G-Bn-Bn-Bn-A-Bn-A-G-C-G | 28 |
| 4149-8_39 | Bn-Bn-A-C-G-A-C-Bn-A-C-G-Bn-Bn-A-C-A-C-G-C-G-Bn-Bn-Bn-A-Bn-A-G-C | 29 |
| 4149-8_40 | Bn-Bn-A-C-G-A-C-Bn-A-C-G-Bn-Bn-A-C-A-C-G-C-G-Bn-Bn-Bn-A-Bn-A-G | 30 |
| 4149-8_44 | Bn-Bn-A$^1$-C-G-A-C-Bn-A-C-G-Bn-Bn-A-C-A-C-G-C-G-Bn-Bn-Bn-A-Bn-A-G-C-G | 31 |
| 4149-8_45 | Bn-Bn-A-C$^1$-G-A-C-Bn-A-C-G-Bn-Bn-A-C-A-C-G-C-G-Bn-Bn-Bn-A-Bn-A-G-C-G | 32 |
| 4149-8_46 | Bn-Bn-A-C-G$^1$-A-C-Bn-A-C-G-Bn-Bn-A-C-A-C-G-C-G-Bn-Bn-Bn-A-Bn-A-G-C-G | 33 |
| 4149-8_47 | Bn-Bn-A-C-G-A$^1$-C-Bn-A-C-G-Bn-Bn-A-C-A-C-G-C-G-Bn-Bn-Bn-A-Bn-A-G-C-G | 34 |
| 4149-8_48 | Bn-Bn-A-C-G-A-C$^1$-Bn-A-C-G-Bn-Bn-A-C-A-C-G-C-G-Bn-Bn-Bn-A-Bn-A-G-C-G | 35 |
| 4149-8_49 | Bn-Bn-A-C-G-A-C-Bn-A$^1$-C-G-Bn-Bn-A-C-A-C-G-C-G-Bn-Bn-Bn-A-Bn-A-G-C-G | 36 |
| 4149-8_50 | Bn-Bn-A-C-G-A-C-Bn-A-C$^1$-G-Bn-Bn-A-C-A-C-G-C-G-Bn-Bn-Bn-A-Bn-A-G-C-G | 37 |
| 4149-8_51 | Bn-Bn-A-C-G-A-C-Bn-A-C-G$^1$-Bn-Bn-A-C-A-C-G-C-G-Bn-Bn-Bn-A-Bn-A-G-C-G | 38 |
| 4149-8_52 | Bn-Bn-A-C-G-A-C-Bn-A-C-G-Bn-Bn-A$^1$-C-A-C-G-C-G-Bn-Bn-Bn-A-Bn-A-G-C-G | 39 |

TABLE 1-continued

Sequences Representative of the 4149-8_1 and Truncated Variants with $K_d$ values for PDGF of 10 nM or less

| Aptamer ID. No. | Sequence (5'→ 3') | SEQ ID NO. |
| --- | --- | --- |
| 4149-8_53 | Bn-Bn-A-C-G-A-C-Bn-A-C-G-Bn-Bn-A-C$^1$-A-C-G-C-G-Bn-Bn-Bn-A-Bn-A-G-C-G | 40 |
| 4149-8_54 | Bn-Bn-A-C-G-A-C-Bn-A-C-G-Bn-Bn-A-C-A$^1$-C-G-C-G-Bn-Bn-Bn-A-Bn-A-G-C-G | 41 |
| 4149-8_55 | Bn-Bn-A-C-G-A-C-Bn-A-C-G-Bn-Bn-A-C-A-C$^1$-G-C-G-Bn-Bn-Bn-A-Bn-A-G-C-G | 42 |
| 4149-8_56 | Bn-Bn-A-C-G-A-C-Bn-A-C-G-Bn-Bn-A-C-A-C-G$^1$-C-G-Bn-Bn-Bn-A-Bn-A-G-C-G | 43 |
| 4149-8_57 | Bn-Bn-A-C-G-A-C-Bn-A-C-G-Bn-Bn-A-C-A-C-G-C$^1$-G-Bn-Bn-Bn-A-Bn-A-G-C-G | 44 |
| 4149-8_58 | Bn-Bn-A-C-G-A-C-Bn-A-C-G-Bn-Bn-A-C-A-C-G-C-G$^1$-Bn-Bn-Bn-A-Bn-A-G-C-G | 45 |
| 4149-8_59 | Bn-Bn-A-C-G-A-C-Bn-A-C-G-Bn-Bn-A-C-A-C-G-C-G-Bn-Bn-Bn-A$^1$-Bn-A-G-C-G | 46 |
| 4149-8_60 | Bn-Bn-A-C-G-A-C-Bn-A-C-G-Bn-Bn-A-C-A-C-G-C-G-Bn-Bn-Bn-A-Bn-A$^1$-G-C-G | 47 |
| 4149-8_61 | Bn-Bn-A-C-G-A-C-Bn-A-C-G-Bn-Bn-A-C-A-C-G-C-G-Bn-Bn-Bn-A-Bn-A-G$^1$-C-G | 48 |
| 4149-8_62 | Bn-Bn-A-C-G-A-C-Bn-A-C-G-Bn-Bn-A-C-A-C-G-C-G-Bn-Bn-Bn-A-Bn-A-G-C$^1$-G | 49 |
| 4149-8_63 | Bn-Bn-A-C-G-A-C-Bn-A-C-G-Bn-Bn-A-C-A-C-G-C-G-Bn-Bn-Bn-A-Bn-A-G-C-G$^1$ | 50 |
| 4149-8_64 | C3-Bn-A-C-G-A-C-Bn-A-C-G-Bn-Bn-A-C-A-C-G-C-G-Bn-Bn-Bn-A-Bn-A-G-C-G | 51 |
| 4149-8_67 | Bn-Bn-A-C3-G-A-C-Bn-A-C-G-Bn-Bn-A-C-A-C-G-C-G-Bn-Bn-Bn-A-Bn-A-G-C-G | 52 |
| 4149-8_68 | Bn-Bn-A-C-C3-A-C-Bn-A-C-G-Bn-Bn-A-C-A-C-G-C-G-Bn-Bn-Bn-A-Bn-A-G-C-G | 53 |
| 4149-8_69 | Bn-Bn-A-C-G-C3-C-Bn-A-C-G-Bn-Bn-A-C-A-C-G-C-G-Bn-Bn-Bn-A-Bn-A-G-C-G | 54 |
| 4149-8_70 | Bn-Bn-A-C-G-A-C3-Bn-A-C-G-Bn-Bn-A-C-A-C-G-C-G-Bn-Bn-Bn-A-Bn-A-G-C-G | 55 |
| 4149-8_71 | Bn-Bn-A-C-G-A-C-C3-A-C-G-Bn-Bn-A-C-A-C-G-C-G-Bn-Bn-Bn-A-Bn-A-G-C-G | 56 |
| 4149-8_72 | Bn-Bn-A-C-G-A-C-Bn-C3-C-G-Bn-Bn-A-C-A-C-G-C-G-Bn-Bn-Bn-A-Bn-A-G-C-G | 57 |
| 4149-8_73 | Bn-Bn-A-C-G-A-C-Bn-A-C3-G-Bn-Bn-A-C-A-C-G-C-G-Bn-Bn-Bn-A-Bn-A-G-C-G | 58 |
| 4149-8_78 | Bn-Bn-A-C-G-A-C-Bn-A-C-G-Bn-Bn-C3-A-C-G-C-G-Bn-Bn-Bn-A-Bn-A-G-C-G | 59 |
| 4149-8_79 | Bn-Bn-A-C-G-A-C-Bn-A-C-G-Bn-Bn-A-C-C3-C-G-C-G-Bn-Bn-Bn-A-Bn-A-G-C-G | 60 |
| 4149-8_80 | Bn-Bn-A-C-G-A-C-Bn-A-C-G-Bn-Bn-A-C-A-C3-G-C-G-Bn-Bn-Bn-A-Bn-A-G-C-G | 61 |
| 4149-8_87 | Bn-Bn-A-C-G-A-C-Bn-A-C-G-Bn-Bn-A-C-A-C-G-C-G-Bn-Bn-Bn-C3-Bn-A-G-C-G | 62 |
| 4149-8_91 | Bn-Bn-A-C-G-A-C-Bn-A-C-G-Bn-Bn-A-C-A-C-G-C-G-Bn-Bn-Bn-A-Bn-A-G-C3-G | 63 |
| 4149-8_92 | Bn-Bn-A-C-G-A-C-Bn-A-C-G-Bn-Bn-A-C-A-C-G-C-G-Bn-Bn-Bn-A-Bn-A-G-C-C3 | 64 |

TABLE 1-continued

Sequences Representative of the 4149-8_1 and Truncated Variants with $K_d$ values for PDGF of 10 nM or less

| Aptamer ID. No. | Sequence (5'→ 3') | SEQ ID NO. |
|---|---|---|
| 4149-8_93 | Bn-Bn-A$^1$-C-G-A$^1$-C-Bn-A$^1$-C-G-Bn-Bn-A-C-A$^1$-C-G$^1$-C-G-Bn-Bn-Bn-A$^1$-Bn-A$^1$-G$^1$-C$^1$-G$^1$ | 65 |
| 4149-8_94 | Bn-Bn-A$^1$-C-G-A-C-Bn-A$^1$-C-G-Bn-Bn-A-C-A$^1$-C-G-C-G-Bn-Bn-Bn-A-Bn-A$^1$-G-C-G$^1$ | 66 |
| 4149-8_95 | Bn-Bn-A-C-Heg-G-Bn-Bn-A-C-A-C-G-C-G-Bn-Bn-Bn-A-Bn-A-G-C-G | 67 |
| 4149-8_96 | Bn-Bn-A-C-Heg-Heg-G-Bn-Bn-A-C-A-C-G-C-G-Bn-Bn-Bn-A-Bn-A-G-C-G | 68 |
| 4149-8_97 | Bn-Bn-A-C-G-Heg-C-G-Bn-Bn-A-C-A-C-G-C-G-Bn-Bn-Bn-A-Bn-A-G-C-G | 69 |
| 4149-8_98 | Bn-Bn-A-C-C3-C3-C3-C3-C3-C3-G-Bn-Bn-A-C-A-C-G-C-G-Bn-Bn-Bn-A-Bn-A-G-C-G | 70 |
| 4149-8_99 | Bn-Bn-A-C-C3-C3-C3-G-Bn-Bn-A-C-A-C-G-C-G-Bn-Bn-Bn-A-Bn-A-G-C-G | 71 |
| 4149-8_100 | Bn-Bn-A-C-C3-C3-G-Bn-Bn-A-C-A-C-G-C-G-Bn-Bn-Bn-A-Bn-A-G-C-G | 72 |
| 4149-8_101 | Bn-Bn-A$^1$-C-G-C3-C-C3-C3-C-G-Bn-Bn-A-C-A$^1$-C-G$^1$-C-G-Bn-Bn-Bn-A$^1$-Bn-A$^1$-G$^1$-C-G$^1$ | 73 |
| 4149-8_103 | U$^1$-Bn-A-C-G-A-C-Bn-A-C-G-Bn-Bn-A-C-A-C-G-C-G-Bn-Bn-Bn-A-Bn-A-G-C-G | 74 |
| 4149-8_105 | Bn-Bn-A-C-G-A-C-U$^1$-A-C-G-Bn-Bn-A-C-A-C-G-C-G-Bn-Bn-Bn-A-Bn-A-G-C-G | 75 |
| 4149-8_106 | Bn-Bn-A-C-G-A-C-Bn-A-C-G-U$^1$-Bn-A-C-A-C-G-C-G-Bn-Bn-Bn-A-Bn-A-G-C-G | 76 |
| 4149-8_110 | Bn-Bn-A-C-G-A-C-Bn-A-C-G-Bn-Bn-A-C-A-C-G-C-G-Bn-Bn-U$^1$-A-Bn-A-G-C-G | 77 |
| 4149-8_112 | Bn-Nap-A-C-G-A-C-Bn-A-C-G-Bn-Bn-A-C-A-C-G-C-G-Bn-Bn-Bn-A-Bn-A-G-C-G | 78 |
| 4149-8_113 | Bn-Bn-A-C-G-A-C-Nap-A-C-G-Bn-Bn-A-C-A-C-G-C-G-Bn-Bn-Bn-A-Bn-A-G-C-G | 79 |
| 4149-8_114 | Bn-Bn-A-C-G-A-C-Bn-A-C-G-Nap-Bn-A-C-A-C-G-C-G-Bn-Bn-Bn-A-Bn-A-G-C-G | 80 |
| 4149-8_115 | Bn-Bn-A-C-G-A-C-Bn-A-C-G-Bn-Nap-A-C-A-C-G-C-G-Bn-Bn-Bn-A-Bn-A-G-C-G | 81 |
| 4149-8_116 | Bn-Bn-A-C-G-A-C-Bn-A-C-G-Bn-Bn-A-C-A-C-G-C-G-Nap-Bn-Bn-A-Bn-A-G-C-G | 82 |
| 4149-8_117 | Bn-Bn-A-C-G-A-C-Bn-A-C-G-Bn-Bn-A-C-A-C-G-C-G-Bn-Nap-Bn-A-Bn-A-G-C-G | 83 |
| 4149-8_118 | Bn-Bn-A-C-G-A-C-Bn-A-C-G-Bn-Bn-A-C-A-C-G-C-G-Bn-Bn-Nap-A-Bn-A-G-C-G | 84 |
| 4149-8_119 | Bn-Bn-A-C-G-A-C-Bn-A-C-G-Bn-Bn-A-C-A-C-G-C-G-Bn-Bn-Bn-A-Nap-A-G-C-G | 85 |
| 4149-8_121 | Nap-Bn-A-C-G-A-C-Bn-A-C-G-Bn-Bn-A-C-A-C-G-C-G-Bn-Bn-Bn-A-Bn-A-G-C-G | 86 |
| 4149-8_122 | Bn-Bn-A-C-G-A-C-Bn-A-C-G-Bn-Bn-A-C-A-C-G-C-G-Bn-Bn-Bn-A-U$^1$-A-G-C-G | 87 |
| 4149-8_123 | Bn-Bn-A$^1$-C-Heg-Heg-G-Bn-Bn-A-C-A$^1$-C-G-C-G-Bn-Bn-Bn-A-Bn-A$^1$-G-C-G$^1$ | 88 |
| 4149-8_124 | Bn-Bn-A-C-Heg-Heg-G-Bn-Bn-A-C-A-C-G-C-G-Nap-Bn-Bn-A-Bn-A-G-C-G | 89 |

TABLE 1-continued

Sequences Representative of the 4149-8_1 and Truncated Variants with $K_d$ values for PDGF of 10 nM or less

| Aptamer ID. No. | Sequence (5'→ 3') | SEQ ID NO. |
|---|---|---|
| 4149-8_125 | Bn-Bn-A-C-Heg-Heg-G-U$^1$-Bn-A-C-A-C-G-C-G-Bn-Bn-Bn-A-Bn-A-G-C-G | 90 |
| 4149-8_126 | Bn-Bn-A$^1$-C-Heg-Heg-G-U$^1$-Bn-A-C-A$^1$-C-G-C-G-Nap-Bn-Bn-A-Bn-A$^1$-G-C-G$^1$ | 91 |
| 4149-8_128 | Bn-Nap-A$^1$-C-Heg-Heg-G-Nap-Nap-A-C-A$^1$-C-G-C-G-Nap-Nap-Bn-A-Nap-A$^1$-G-C-G$^1$ | 92 |
| 4149-8_130 | Bn-Bn-A$^1$-C-Heg-G-Bn-Bn-A-C-A$^1$-C-G-C-G-Bn-Bn-Bn-A-Bn-A$^1$-G-C-G$^1$ | 93 |
| 4149-8_131 | Bn-Bn-A-C-Heg-G-Bn-Bn-A-C-A-C-G-C-G-Nap-Bn-Bn-A-Bn-A-G-C-G | 94 |
| 4149-8_132 | Bn-Bn-A-C-Heg-G-U$^1$-Bn-A-C-A-C-G-C-G-Bn-Bn-Bn-A-Bn-A-G-C-G | 95 |
| 4149-8_133 | Bn-Bn-A$^1$-C-Heg-G-U$^1$-Bn-A-C-A$^1$-C-G-C-G-Nap-Bn-Bn-A-Bn-A$^1$-G-C-G$^1$ | 96 |
| 4149-8_135 | Pe-Bn-A$^1$-C-Heg-G-Bn-Bn-A-C-A$^1$-C-G-C-G-Bn-Bn-Bn-A-Bn-A$^1$-G-C-G$^1$ | 97 |
| 4149-8_136 | Bn-Pe-A$^1$-C-Heg-G-Bn-Bn-A-C-A$^1$-C-G-C-G-Bn-Bn-Bn-A-Bn-A$^1$-G-C-G$^1$ | 98 |
| 4149-8_137 | Bn-Bn-A$^1$-C-Heg-G-Pe-Bn-A-C-A$^1$-C-G-C-G-Bn-Bn-Bn-A-Bn-A$^1$-G-C-G$^1$ | 99 |
| 4149-8_138 | Bn-Bn-A$^1$-C-Heg-G-Bn-Pe-A-C-A$^1$-C-G-C-G-Bn-Bn-Bn-A-Bn-A$^1$-G-C-G$^1$ | 100 |
| 4149-8_139 | Bn-Bn-A$^1$-C-Heg-G-Bn-Bn-A-C-A$^1$-C-G-C-G-Pe-Bn-Bn-A-Bn-A$^1$-G-C-G$^1$ | 101 |
| 4149-8_140 | Bn-Bn-A$^1$-C-Heg-G-Bn-Bn-A-C-A$^1$-C-G-C-G-Bn-Pe-Bn-A-Bn-A$^1$-G-C-G$^1$ | 102 |
| 4149-8_141 | Bn-Bn-A$^1$-C-Heg-G-Bn-Bn-A-C-A$^1$-C-G-C-G-Bn-Bn-Pe-A-Bn-A$^1$-G-C-G$^1$ | 103 |
| 4149-8_142 | Bn-Bn-A$^1$-C-Heg-G-Bn-Bn-A-C-A$^1$-C-G-C-G-Bn-Bn-Bn-A-Pe-A$^1$-G-C-G$^1$ | 104 |
| 4149-8_143 | BT-Bn-A$^1$-C-Heg-G-Bn-Bn-A-C-A$^1$-C-G-C-G-Bn-Bn-Bn-A-Bn-A$^1$-G-C-G$^1$ | 105 |
| 4149-8_144 | Bn-BT-A$^1$-C-Heg-G-Bn-Bn-A-C-A$^1$-C-G-C-G-Bn-Bn-Bn-A-Bn-A$^1$-G-C-G$^1$ | 106 |
| 4149-8_145 | Bn-Bn-A$^1$-C-Heg-G-BT-Bn-A-C-A$^1$-C-G-C-G-Bn-Bn-Bn-A-Bn-A$^1$-G-C-G$^1$ | 107 |
| 4149-8_146 | Bn-Bn-A$^1$-C-Heg-G-Bn-BT-A-C-A$^1$-C-G-C-G-Bn-Bn-Bn-A-Bn-A$^1$-G-C-G$^1$ | 108 |
| 4149-8_147 | Bn-Bn-A$^1$-C-Heg-G-Bn-Bn-A-C-A$^1$-C-G-C-G-BT-Bn-Bn-A-Bn-A$^1$-G-C-G$^1$ | 109 |
| 4149-8_148 | Bn-Bn-A$^1$-C-Heg-G-Bn-Bn-A-C-A$^1$-C-G-C-G-Bn-BT-Bn-A-Bn-A$^1$-G-C-G$^1$ | 110 |
| 4149-8_149 | Bn-Bn-A$^1$-C-Heg-G-Bn-Bn-A-C-A$^1$-C-G-C-G-Bn-Bn-BT-A-Bn-A$^1$-G-C-G$^1$ | 111 |
| 4149-8_150 | Bn-Bn-A$^1$-C-Heg-G-Bn-Bn-A-C-A$^1$-C-G-C-G-Bn-Bn-Bn-A-BT-A$^1$-G-C-G$^1$ | 112 |
| 4149-8_151 | Th-Bn-A$^1$-C-Heg-G-Bn-Bn-A-C-A$^1$-C-G-C-G-Bn-Bn-Bn-A-Bn-A$^1$-G-C-G$^1$ | 113 |
| 4149-8_152 | Bn-Th-A$^1$-C-Heg-G-Bn-Bn-A-C-A$^1$-C-G-C-G-Bn-Bn-Bn-A-Bn-A$^1$-G-C-G$^1$ | 114 |

TABLE 1-continued

Sequences Representative of the 4149-8_1 and Truncated Variants with $K_d$ values for PDGF of 10 nM or less

| Aptamer ID. No. | Sequence (5'→ 3') | SEQ ID NO. |
|---|---|---|
| 4149-8_153 | Bn-Bn-A$^1$-C-Heg-G-Th-Bn-A-C-A$^1$-C-G-C-G-Bn-Bn-Bn-A-Bn-A$^1$-G-C-G$^1$ | 115 |
| 4149-8_154 | Bn-Bn-A$^1$-C-Heg-G-Bn-Th-A-C-A$^1$-C-G-C-G-Bn-Bn-Bn-A-Bn-A$^1$-G-C-G$^1$ | 116 |
| 4149-8_155 | Bn-Bn-A$^1$-C-Heg-G-Bn-Bn-A-C-A$^1$-C-G-C-Th-Bn-Bn-A-Bn-A$^1$-G-C-G$^1$ | 117 |
| 4149-8_156 | Bn-Bn-A$^1$-C-Heg-G-Bn-Bn-A-C-A$^1$-C-G-C-G-Bn-Th-Bn-A-Bn-A$^1$-G-C-G$^1$ | 118 |
| 4149-8_157 | Bn-Bn-A$^1$-C-Heg-G-Bn-Bn-A-C-A$^1$-C-G-C-G-Bn-Bn-Th-A-Bn-A$^1$-G-C-G$^1$ | 119 |
| 4149-8_158 | Bn-Bn-A$^1$-C-Heg-G-Bn-Bn-A-C-A$^1$-C-G-C-G-Bn-Bn-Bn-A-Th-A$^1$-G-C-G$^1$ | 120 |
| 4149-8_159 | Nap-Bn-A$^1$-C-Heg-G-Bn-Bn-A-C-A$^1$-C-G-C-G-Bn-Bn-Bn-A-Bn-A$^1$-G-C-G$^1$ | 121 |
| 4149-8_160 | Bn-Nap-A$^1$-C-Heg-G-Bn-Bn-A-C-A$^1$-C-G-C-G-Bn-Bn-Bn-A-Bn-A$^1$-G-C-G$^1$ | 122 |
| 4149-8_161 | Bn-Bn-A$^1$-C-Heg-G-Nap-Bn-A-C-A$^1$-C-G-C-G-Bn-Bn-Bn-A-Bn-A$^1$-G-C-G$^1$ | 123 |
| 4149-8_162 | Bn-Bn-A$^1$-C-Heg-G-Bn-Nap-A-C-A$^1$-C-G-C-G-Bn-Bn-Bn-A-Bn-A$^1$-G-C-G$^1$ | 124 |
| 4149-8_163 | Bn-Bn-A$^1$-C-Heg-G-Bn-Bn-A-C-A$^1$-C-G-C-G-Nap-Bn-Bn-A-Bn-A$^1$-G-C-G$^1$ | 125 |
| 4149-8_164 | Bn-Bn-A$^1$-C-Heg-G-Bn-Bn-A-C-A$^1$-C-G-C-G-Bn-Nap-Bn-A-Bn-A$^1$-G-C-G$^1$ | 126 |
| 4149-8_165 | Bn-Bn-A$^1$-C-Heg-G-Bn-Bn-A-C-A$^1$-C-G-C-G-Bn-Bn-Nap-A-Bn-A$^1$-G-C-G$^1$ | 127 |
| 4149-8_166 | Bn-Bn-A$^1$-C-Heg-G-Bn-Bn-A-C-A$^1$-C-G-C-G-Bn-Bn-Bn-A-Nap-A$^1$-G-C-G$^1$ | 128 |
| 4149-8_167 | Ib-Bn-A$^1$-C-Heg-G-Bn-Bn-A-C-A$^1$-C-G-C-G-Bn-Bn-Bn-A-Bn-A$^1$-G-C-G$^1$ | 129 |
| 4149-8_168 | Bn-Ib-A$^1$-C-Heg-G-Bn-Bn-A-C-A$^1$-C-G-C-G-Bn-Bn-Bn-A-Bn-A$^1$-G-C-G$^1$ | 130 |
| 4149-8_169 | Bn-Bn-A$^1$-C-Heg-G-Ib-Bn-A-C-A$^1$-C-G-C-G-Bn-Bn-Bn-A-Bn-A$^1$-G-C-G$^1$ | 131 |
| 4149-8_170 | Bn-Bn-A$^1$-C-Heg-G-Bn-Ib-A-C-A$^1$-C-G-C-G-Bn-Bn-Bn-A-Bn-A$^1$-G-C-G$^1$ | 132 |
| 4149-8_171 | Bn-Bn-A$^1$-C-Heg-G-Bn-Bn-A-C-A$^1$-C-G-C-G-Ib-Bn-Bn-A-Bn-A$^1$-G-C-G$^1$ | 133 |
| 4149-8_172 | Bn-Bn-A$^1$-C-Heg-G-Bn-Bn-A-C-A$^1$-C-G-C-G-Bn-Ib-Bn-A-Bn-A$^1$-G-C-G$^1$ | 134 |
| 4149-8_173 | Bn-Bn-A$^1$-C-Heg-G-Bn-Bn-A-C-A$^1$-C-G-C-G-Bn-Bn-Ib-A-Bn-A$^1$-G-C-G$^1$ | 135 |
| 4149-8_174 | Bn-Bn-A$^1$-C-Heg-G-Bn-Bn-A-C-A$^1$-C-G-C-G-Bn-Bn-Bn-A-Ib-A$^1$-G-C-G$^1$ | 136 |
| 4149-8_175 | Trp-Bn-A$^1$-C-Heg-G-Bn-Bn-A-C-A$^1$-C-G-C-G-Bn-Bn-Bn-A-Bn-A$^1$-G-C-G$^1$ | 137 |
| 4149-8_176 | Bn-Trp-A$^1$-C-Heg-G-Bn-Bn-A-C-A$^1$-C-G-C-G-Bn-Bn-Bn-A-Bn-A$^1$-G-C-G$^1$ | 138 |
| 4149-8_177 | Bn-Bn-A$^1$-C-Heg-G-Trp-Bn-A-C-A$^1$-C-G-C-G-Bn-Bn-Bn-A-Bn-A$^1$-G-C-G$^1$ | 139 |

TABLE 1-continued

Sequences Representative of the 4149-8_1 and Truncated Variants with $K_d$ values for PDGF of 10 nM or less

| Aptamer ID. No. | Sequence (5'→ 3') | SEQ ID NO. |
|---|---|---|
| 4149-8_181 | Bn-Bn-A$^1$-C-Heg-G-Bn-Bn-A-C-A$^1$-C-G-C-G-Bn-Bn-Trp-A-Bn-A$^1$-G-C-G$^1$ | 140 |
| 4149-8_182 | Bn-Bn-A$^1$-C-Heg-G-Bn-Bn-A-C-A$^1$-C-G-C-G-Bn-Bn-Bn-A-Trp-A$^1$-G-C-G$^1$ | 141 |
| 4149-8_183 | 2Nap-Bn-A$^1$-C-Heg-G-Bn-Bn-A-C-A$^1$-C-G-C-G-Bn-Bn-Bn-A-Bn-A$^1$-G-C-G$^1$ | 142 |
| 4149-8_184 | Bn-2Nap-A$^1$-C-Heg-G-Bn-Bn-A-C-A$^1$-C-G-C-G-Bn-Bn-Bn-A-Bn-A$^1$-G-C-G$^1$ | 143 |
| 4149-8_185 | Bn-Bn-A$^1$-C-Heg-G-2Nap-Bn-A-C-A$^1$-C-G-C-G-Bn-Bn-Bn-A-Bn-A$^1$-G-C-G$^1$ | 144 |
| 4149-8_187 | Bn-Bn-A$^1$-C-Heg-G-Bn-Bn-A-C-A$^1$-C-G-C-G-2Nap-Bn-Bn-A-Bn-A$^1$-G-C-G$^1$ | 145 |
| 4149-8_188 | Bn-Bn-A$^1$-C-Heg-G-Bn-Bn-A-C-A$^1$-C-G-C-G-Bn-2Nap-Bn-A-Bn-A$^1$-G-C-G$^1$ | 146 |
| 4149-8_189 | Bn-Bn-A$^1$-C-Heg-G-Bn-Bn-A-C-A$^1$-C-G-C-G-Bn-Bn-2Nap-A-Bn-A$^1$-G-C-G$^1$ | 147 |
| 4149-8_190 | Bn-Bn-A$^1$-C-Heg-G-Bn-Bn-A-C-A$^1$-C-G-C-G-Bn-Bn-Bn-A-2Nap-A$^1$-G-C-G$^1$ | 148 |
| 4149-8_191 | 2NE-Bn-A$^1$-C-Heg-G-Bn-Bn-A-C-A$^1$-C-G-C-G-Bn-Bn-Bn-A-Bn-A$^1$-G-C-G$^1$ | 149 |
| 4149-8_192 | Bn-2NE-A$^1$-C-Heg-G-Bn-Bn-A-C-A$^1$-C-G-C-G-Bn-Bn-Bn-A-Bn-A$^1$-G-C-G$^1$ | 150 |
| 4149-8_193 | Bn-Bn-A$^1$-C-Heg-G-2NE-A-C-A$^1$-C-G-C-G-Bn-Bn-Bn-A-Bn-A$^1$-G-C-G$^1$ | 151 |
| 4149-8_194 | Bn-Bn-A$^1$-C-Heg-G-Bn-2NE-A-C-A$^1$-C-G-C-G-Bn-Bn-Bn-A-Bn-A$^1$-G-C-G$^1$ | 152 |
| 4149-8_195 | Bn-Bn-A$^1$-C-Heg-G-Bn-Bn-A-C-A$^1$-C-G-C-2NE-Bn-Bn-Bn-A-Bn-A$^1$-G-C-G$^1$ | 153 |
| 4149-8_197 | Bn-Bn-A$^1$-C-Heg-G-Bn-Bn-A-C-A$^1$-C-G-C-G-Bn-Bn-2NE-A-Bn-A$^1$-G-C-G$^1$ | 154 |
| 4149-8_198 | Bn-Bn-A$^1$-C-Heg-G-Bn-Bn-A-C-A$^1$-C-G-C-G-Bn-Bn-Bn-A-2NE-A$^1$-G-C-G$^1$ | 155 |
| 4149-8_199 | NE-Bn-A$^1$-C-Heg-G-Bn-Bn-A-C-A$^1$-C-G-C-G-Bn-Bn-Bn-A-Bn-A$^1$-G-C-G$^1$ | 156 |
| 4149-8_200 | Bn-NE-A$^1$-C-Heg-G-Bn-Bn-A-C-A$^1$-C-G-C-G-Bn-Bn-Bn-A-Bn-A$^1$-G-C-G$^1$ | 157 |
| 4149-8_201 | Bn-Bn-A$^1$-C-Heg-G-NE-Bn-A-C-A$^1$-C-G-C-G-Bn-Bn-Bn-A-Bn-A$^1$-G-C-G$^1$ | 158 |
| 4149-8_202 | Bn-Bn-A$^1$-C-Heg-G-Bn-NE-A-C-A$^1$-C-G-C-G-Bn-Bn-Bn-A-Bn-A$^1$-G-C-G$^1$ | 159 |
| 4149-8_203 | Bn-Bn-A$^1$-C-Heg-G-Bn-Bn-A-C-A$^1$-C-G-C-NE-Bn-Bn-Bn-A-Bn-A$^1$-G-C-G$^1$ | 160 |
| 4149-8_204 | Bn-Bn-A$^1$-C-Heg-G-Bn-Bn-A-C-A$^1$-C-G-C-G-Bn-NE-Bn-A-Bn-A$^1$-G-C-G$^1$ | 161 |
| 4149-8_205 | Bn-Bn-A$^1$-C-Heg-G-Bn-Bn-A-C-A$^1$-C-G-C-G-Bn-Bn-NE-A-Bn-A$^1$-G-C-G$^1$ | 162 |
| 4149-8_206 | Bn-Bn-A$^1$-C-Heg-G-Bn-Bn-A-C-A$^1$-C-G-C-G-Bn-Bn-Bn-A-NE-A$^1$-G-C-G$^1$ | 163 |
| 4149-8_207 | MBn-Bn-A$^1$-C-Heg-G-Bn-Bn-A-C-A$^1$-C-G-C-G-Bn-Bn-Bn-A-Bn-A$^1$-G-C-G$^1$ | 164 |

TABLE 1-continued

Sequences Representative of the 4149-8_1 and Truncated Variants with $K_d$ values for PDGF of 10 nM or less

| Aptamer ID. No. | Sequence (5'→ 3') | SEQ ID NO. |
|---|---|---|
| 4149-8_208 | Bn-MBn-$A^1$-C-Heg-G-Bn-Bn-A-C-$A^1$-C-G-C-G-Bn-Bn-Bn-A-Bn-$A^1$-G-C-$G^1$ | 165 |
| 4149-8_209 | Bn-Bn-$A^1$-C-Heg-G-MBn-Bn-A-C-$A^1$-C-G-C-G-Bn-Bn-Bn-A-Bn-$A^1$-G-C-$G^1$ | 166 |
| 4149-8_210 | Bn-Bn-$A^1$-C-Heg-G-Bn-MBn-A-C-$A^1$-C-G-C-G-Bn-Bn-Bn-A-Bn-$A^1$-G-C-$G^1$ | 167 |
| 4149-8_211 | Bn-Bn-$A^1$-C-Heg-G-Bn-Bn-A-C-$A^1$-C-G-C-G-MBn-Bn-Bn-A-Bn-$A^1$-G-C-$G^1$ | 168 |
| 4149-8_212 | Bn-Bn-$A^1$-C-Heg-G-Bn-Bn-A-C-$A^1$-C-G-C-G-Bn-MBn-Bn-A-Bn-$A^1$-G-C-$G^1$ | 169 |
| 4149-8_213 | Bn-Bn-$A^1$-C-Heg-G-Bn-Bn-A-C-$A^1$-C-G-C-G-Bn-Bn-MBn-A-Bn-$A^1$-G-C-$G^1$ | 170 |
| 4149-8_214 | Bn-Bn-$A^1$-C-Heg-G-Bn-Bn-A-C-$A^1$-C-G-C-G-Bn-Bn-Bn-A-MBn-$A^1$-G-C-$G^1$ | 171 |
| 4149-8_215 | PP-Bn-$A^1$-C-Heg-G-Bn-Bn-A-C-$A^1$-C-G-C-G-Bn-Bn-Bn-A-Bn-$A^1$-G-C-$G^1$ | 172 |
| 4149-8_216 | Bn-PP-$A^1$-C-Heg-G-Bn-Bn-A-C-$A^1$-C-G-C-G-Bn-Bn-Bn-A-Bn-$A^1$-G-C-$G^1$ | 173 |
| 4149-8_217 | Bn-Bn-$A^1$-C-Heg-G-PP-Bn-A-C-$A^1$-C-G-C-G-Bn-Bn-Bn-A-Bn-$A^1$-G-C-$G^1$ | 174 |
| 4149-8_218 | Bn-Bn-$A^1$-C-Heg-G-Bn-PP-A-C-$A^1$-C-G-C-G-Bn-Bn-Bn-A-Bn-$A^1$-G-C-$G^1$ | 175 |
| 4149-8_219 | Bn-Bn-$A^1$-C-Heg-G-Bn-Bn-A-C-$A^1$-C-G-C-G-PP-Bn-Bn-A-Bn-$A^1$-G-C-$G^1$ | 176 |
| 4149-8_220 | Bn-Bn-$A^1$-C-Heg-G-Bn-Bn-A-C-$A^1$-C-G-C-G-Bn-PP-Bn-A-Bn-$A^1$-G-C-$G^1$ | 177 |
| 4149-8_221 | Bn-Bn-$A^1$-C-Heg-G-Bn-Bn-A-C-$A^1$-C-G-C-G-Bn-Bn-PP-A-Bn-$A^1$-G-C-$G^1$ | 178 |
| 4149-8_222 | Bn-Bn-$A^1$-C-Heg-G-Bn-Bn-A-C-$A^1$-C-G-C-G-Bn-Bn-Bn-A-PP-$A^1$-G-C-$G^1$ | 179 |
| 4149-8_223 | Tyr-Bn-$A^1$-C-Heg-G-Bn-Bn-A-C-$A^1$-C-G-C-G-Bn-Bn-Bn-A-Bn-$A^1$-G-C-$G^1$ | 180 |
| 4149-8_224 | Bn-Tyr-$A^1$-C-Heg-G-Bn-Bn-A-C-$A^1$-C-G-C-G-Bn-Bn-Bn-A-Bn-$A^1$-G-C-$G^1$ | 181 |
| 4149-8_225 | Bn-Bn-$A^1$-C-Heg-G-Tyr-Bn-A-C-$A^1$-C-G-C-G-Bn-Bn-Bn-A-Bn-$A^1$-G-C-$G^1$ | 182 |
| 4149-8_226 | Bn-Bn-$A^1$-C-Heg-G-Bn-Tyr-A-C-$A^1$-C-G-C-G-Bn-Bn-Bn-A-Bn-$A^1$-G-C-$G^1$ | 183 |
| 4149-8_227 | Bn-Bn-$A^1$-C-Heg-G-Bn-Bn-A-C-$A^1$-C-G-C-G-Tyr-Bn-Bn-A-Bn-$A^1$-G-C-$G^1$ | 184 |
| 4149-8_228 | Bn-Bn-$A^1$-C-Heg-G-Bn-Bn-A-C-$A^1$-C-G-C-G-Bn-Tyr-Bn-A-Bn-$A^1$-G-C-$G^1$ | 185 |
| 4149-8_229 | Bn-Bn-$A^1$-C-Heg-G-Bn-Bn-A-C-$A^1$-C-G-C-G-Bn-Bn-Tyr-A-Bn-$A^1$-G-C-$G^1$ | 186 |
| 4149-8_230 | Bn-Bn-$A^1$-C-Heg-G-Bn-Bn-A-C-$A^1$-C-G-C-G-Bn-Bn-Bn-A-Tyr-$A^1$-G-C-$G^1$ | 187 |
| 4149-8_231 | FBn-Bn-$A^1$-C-Heg-G-Bn-Bn-A-C-$A^1$-C-G-C-G-Bn-Bn-Bn-A-Bn-$A^1$-G-C-$G^1$ | 188 |
| 4149-8_232 | Bn-FBn-$A^1$-C-Heg-G-Bn-Bn-A-C-$A^1$-C-G-C-G-Bn-Bn-Bn-A-Bn-$A^1$-G-C-$G^1$ | 189 |

TABLE 1-continued

Sequences Representative of the 4149-8_1 and Truncated Variants with $K_d$ values for PDGF of 10 nM or less

| Aptamer ID. No. | Sequence (5'→ 3') | SEQ ID NO. |
|---|---|---|
| 4149-8_233 | Bn-Bn-A$^1$-C-Heg-G-FBn-Bn-A-C-A$^1$-C-G-C-G-Bn-Bn-Bn-A-Bn-A$^1$-G-C-G$^1$ | 190 |
| 4149-8_234 | Bn-Bn-A$^1$-C-Heg-G-Bn-FBn-A-C-A$^1$-C-G-C-G-Bn-Bn-Bn-A-Bn-A$^1$-G-C-G$^1$ | 191 |
| 4149-8_235 | Bn-Bn-A$^1$-C-Heg-G-Bn-Bn-A-C-A$^1$-C-G-C-G-FBn-Bn-Bn-A-Bn-A$^1$-G-C-G$^1$ | 192 |
| 4149-8_236 | Bn-Bn-A$^1$-C-Heg-G-Bn-Bn-A-C-A$^1$-C-G-C-G-Bn-FBn-Bn-A-Bn-A$^1$-G-C-G$^1$ | 193 |
| 4149-8_237 | Bn-Bn-A$^1$-C-Heg-G-Bn-Bn-A-C-A$^1$-C-G-C-G-Bn-Bn-FBn-A-Bn-A$^1$-G-C-G$^1$ | 194 |
| 4149-8_238 | Bn-Bn-A$^1$-C-Heg-G-Bn-Bn-A-C-A$^1$-C-G-C-G-Bn-Bn-Bn-A-FBn-A$^1$-G-C-G$^1$ | 195 |
| 4149-8_239 | Bn-Bn-A$^1$-C$^o$-Heg-G-Bn-Bn-A-C-A1-C-G-C-G-Bn-Bn-Bn-A-Bn-A$^1$-G-C-G$^1$ | 196 |
| 4149-8_240 | Bn-Bn-A$^1$-C-Heg-G-Bn-Bn-A-C$^o$-A1-C-G-C-G-Bn-Bn-Bn-A-Bn-A$^1$-G-C-G$^1$ | 197 |
| 4149-8_241 | Bn-Bn-A$^1$-C-Heg-G-Bn-Bn-A-C-A$^1$-C$^o$-G-C-G-Bn-Bn-Bn-A-Bn-A1-G-C-G$^1$ | 198 |
| 4149-8_242 | Bn-Bn-A$^1$-C-Heg-G-Bn-Bn-A-C-A$^1$-C-G-C$^o$-G-Bn-Bn-Bn-A-Bn-A1-G-C-G$^1$ | 199 |
| 4149-8_243 | Bn-Bn-A$^1$-C-Heg-G-Bn-Bn-A-C-A$^1$-C-G-C-G-Bn-Bn-Bn-A-Bn-A$^1$-G-C$^{o-G1}$ | 200 |
| 4149-8_245 | Bn-Bn-A$^1$-C-Heg-G-Bn-Bn-A-C-A$^1$-C-G-C-G-Bn-Bn-Bn-A$^1$-Bn-A$^1$-G-C-G$^1$ | 201 |
| 4149-8_246 | Bn-Bn-A$^1$-C-Heg-G$^1$-Bn-Bn-A-C-A$^1$-C-G-C-G-Bn-Bn-Bn-A-Bn-A$^1$-G-C-G$^1$ | 202 |
| 4149-8_247 | Bn-Bn-A$^1$-C-Heg-G-Bn-Bn-A-C-A$^1$-C-G$^1$-C-G-Bn-Bn-Bn-A-Bn-A$^1$-G-C-G$^1$ | 203 |
| 4149-8_248 | Bn-Bn-A$^1$-C-Heg-G-Bn-Bn-A-C-A$^1$-C-G-C-G$^1$-Bn-Bn-Bn-A-Bn-A$^1$-G-C-G$^1$ | 204 |
| 4149-8_249 | Bn-Bn-A$^1$-C-Heg-G-Bn-Bn-A-C-A$^1$-C-G-C-G-Bn-Bn-Bn-A-Bn-A$^1$-G$^1$-C-G$^1$ | 205 |
| 4149-8_254 | Tyr-Bn-A$^1$-C-Heg-G-FBn-Bn-A-C-A$^1$-C-G-C-G-2Nap-Bn-Bn-A-Bn-A$^1$-G-C-G$^1$ | 206 |
| 4149-8_255 | Bn-Bn-A$^1$-C-Heg-G-Bn-Ib-A-C-A$^1$-C-G-C-G-Bn-Pe-Th-A-Bn-A$^1$-G-C-G$^1$ | 207 |
| 4149-8_256 | Bn-Bn-A$^1$-C-Heg-G-2Nap-Ib-A-C-A$^1$-C-G-C-G-Bn-Bn-Bn-A-Bn-A$^1$-G-C-G$^1$ | 208 |
| 4149-8_257 | Bn-Bn-A$^1$-C-Heg-G-NE-Ib-A-C-A$^1$-C-G-C-G-Bn-Bn-Bn-A-Bn-A$^1$-G-C-G$^1$ | 209 |
| 4149-8_259 | Bn-Bn-A$^1$-C-Heg-G-Ib-1b-A-C-A$^1$-C-G-C-G-Bn-Bn-Bn-A-Bn-A$^1$-G-C-G$^1$ | 210 |
| 4149-8_260 | Bn-Bn-A$^1$-C-Heg-G-Bn-Bn-A-C-A$^1$-C-G-C-G-Bn-Pe-Th-A-Bn-A$^1$-G-C-G$^1$ | 211 |
| 4149-8_261 | Bn-Bn-A$^1$-C-Heg-G-Bn-Bn-A-C-A$^1$-C-G-C-G-Bn-Pe-Pe-A-Bn-A$^1$-G-C-G$^1$ | 212 |
| 4149-8_262 | Bn-Bn-A$^1$-C-Heg-G-Bn-Bn-A-C-A$^1$-C-G-C-G-Bn-Th-Th-A-Bn-A$^1$-G-C-G$^1$ | 213 |
| 4149-8_263 | Bn-Bn-A$^1$-C-Heg-G-Bn-Bn-A-C-A$^1$-C-G-C-G-2Nap-Pe-Th-A-Bn-A$^1$-G-C-G$^1$ | 214 |

TABLE 1-continued

Sequences Representative of the 4149-8_1 and Truncated Variants with $K_d$ values for PDGF of 10 nM or less

| Aptamer ID. No. | Sequence (5'→ 3') | SEQ ID NO. |
|---|---|---|
| 4149-8_264 | Bn-Bn-A$^1$-C-Heg-G-Bn-Bn-A-C-A$^1$-C-G-C-G-Th-Pe-Th-A-Bn-A$^1$-G-C-G$^1$ | 215 |
| 4149-8_265 | Bn-Bn-A$^1$-C-Heg-G-Bn-Bn-A-C-A$^1$-C-G-C-G-Ib-Pe-Th-A-Bn-A$^1$-G-C-G$^1$ | 216 |
| 4149-8_266 | Bn-Bn-A$^1$-C-Heg-G-Bn-Ib-A-C-A$^1$-C-G-C-G-Th-Pe-Th-A-Bn-A$^1$-G-C-G$^1$ | 217 |
| 4149-8_267 | Bn-Ib-A$^1$-C-Heg-G-Ib-Ib-A-C-A$^1$-C-G-C-G-Ib-Bn-Bn-A-Bn-A$^1$-G-C-G$^1$ | 218 |
| 4149-8_268 | 2Nap-2Nap-A$^1$-C-Heg-G-2Nap-Bn-A-C-A$^1$-C-G-C-G-2Nap-Bn-Bn-A-Bn-A$^1$-G-C-G$^1$ | 219 |
| 4149-8_269 | NE-Bn-A$^1$-C-Heg-G-NE-Bn-A-C-A$^1$-C-G-C-G-Bn-Bn-Bn-A-NE-A$^1$-G-C-G$^1$ | 220 |
| 4149-8_270 | Th-Bn-A$^1$-C-Heg-G-Bn-Bn-A-C-A$^1$-C-G-C-G-Th-Bn-Th-A-Bn-A$^1$-G-C-G$^1$ | 221 |
| 4149-8_271 | Bn-Bn-A$^1$-C-Heg-G-Bn-Bn-A-C-A$^1$-C$^1$-G-C-G-Bn-Bn-Bn-A$^1$-Bn-A$^1$-G$^1$-C-G$^1$ | 222 |
| 4149-8_272 | Bn-Bn-A$^1$-C-Heg-G-Bn-Bn-A-C-A$^1$-C-G-C-G-Bn-Bn-Bn-A$^1$-Bn-A$^1$-G$^1$-C-G$^1$ | 223 |
| 4149-8_273 | Bn-Bn-A$^1$-C-Heg-G-Bn-Bn-A-C-A$^1$-C$^1$-G-C-G-Bn-Bn-Bn-A$^1$-Bn-A$^1$-G-C-G$^1$ | 224 |
| 4149-8_274 | Bn-Bn-A$^1$-C-Heg-G-Bn-Bn-A-C-A$^1$-C$^1$-G-C-G-Bn-Bn-Bn-A-Bn-A$^1$-G$^1$-C-G$^1$ | 225 |
| 4149-8_275 | Bn-Bn-A$^1$-C-Heg-G-Bn-Ib-A-C-A$^1$-C-G-C-G-2Nap-Pe-Th-A-Bn-A$^1$-G-C-G$^1$ | 226 |
| 4149-8_279 | Bn-Bn-A$^1$-C-Heg-G-Bn-Ib-A-C-A$^1$-C$^1$-G-C-G-Bn-Pe-Th-A-Bn-A$^1$-G-C-G$^1$ | 227 |
| 4149-8_280 | Bn-Bn-A$^1$-C-Heg-G-Bn-Ib-A-C-A$^1$-C-G-C-G-Bn-Pe-Th-A$^1$-Bn-A$^1$-G-C-G$^1$ | 228 |
| 4149-8_281 | Bn-Bn-A$^1$-C-Heg-G-Bn-Ib-A-C-A$^1$-C-G-C-G-Bn-Pe-Th-A-Bn-A$^1$-G$^1$-C-G$^1$ | 229 |
| 4149-8_282 | Bn-Bn-A$^1$-C-Heg-G-Bn-Ib-A-C-A$^1$-C$^1$-G-C-G-Bn-Pe-Th-A$^1$-Bn-A$^1$-G-C-G$^1$ | 230 |
| 4149-8_283 | Bn-Bn-A$^1$-C-Heg-G-Bn-Ib-A-C-A$^1$-C$^1$-G-C-G-Bn-Pe-Th-A$^1$-Bn-A$^1$-G$^1$-C-G$^1$ | 231 |
| 4149-8_284 | Bn-Bn-A$^1$-C-Heg-G-Bn-Bn-A-C-A$^1$-C$^o$-G-C-G-Bn-Bn-Bn-A1-Bn-A$^1$-G-C-G$^1$ | 232 |
| 4149-8_285 | Bn-Bn-A$^1$-C-Heg-G-Bn-Bn-A-C$^1$-A$^1$-C$^1$-G-C-G-Bn-Bn-Bn-A$^1$-Bn-A$^1$-G-C$^1$-G$^1$ | 233 |
| 4149-8_286 | Bn-Bn-A$^1$-C-Heg-G-Bn-Bn-A-C$^1$-A$^1$-C$^1$-G-C-G-Bn-Bn-Bn-A$^1$-Bn-A$^1$-G$^1$-C$^1$-G$^1$ | 234 |
| 4149-8_287 | Bn-Bn-A$^1$-C-Heg-G-Bn-Bn-A-C-C3-C3-G-C-G-Bn-Bn-Bn-A$^1$-Bn-A$^1$-G-C-G$^1$ | 235 |
| 4149-8_288 | Bn-Bn-A$^1$-C-Heg-G-Bn-Bn-A-C-C3--G-C-G-Bn-Bn-Bn-A$^1$-Bn-A$^1$-G-C-G$^1$ | 236 |
| 4149-8_289 | Bn-Bn-A$^1$-C-Heg-G-Bn-Bn-A-C-C3-C$^1$-G-C-G-Bn-Bn-Bn-A$^1$-Bn-A$^1$-G-C-G$^1$ | 237 |
| 4149-8_290 | Bn-Bn-A$^1$-C-Heg-G-Bn-Bn-A-C-A$^1$-C3-G-C-G-Bn-Bn-Bn-A$^1$-Bn-A$^1$-G-C-G$^1$ | 238 |
| 4149-8_291 | Bn-Bn-A$^1$-C-Heg-G-Bn-Bn-A-C-Heg-G-C-G-Bn-Bn-Bn-A$^1$-Bn-A$^1$-G-C-G$^1$ | 239 |

TABLE 1-continued

Sequences Representative of the 4149-8_1 and Truncated Variants with $K_d$ values for PDGF of 10 nM or less

| A

TABLE 1-continued

Sequences Representative of the 4149-8_1 and Truncated Variants with $K_d$ values for PDGF of 10 nM or less

| Aptamer ID. No. | Sequence (5'→ 3') | SEQ ID NO. |
|---|---|---|
| 4149-8_330 | Bn-Bn-A¹-C-Heg-G-Bn-Bn-A-C-A¹-C¹-G-C-G-Bn-Pe-Bn-A¹-MBn-A¹-G-C-G¹ | 265 |
| 4149-8_331 | Bn-Bn-A¹-C-Heg-G-Bn-Bn-A-C-A¹-C¹-G-C-G-Bn-Pe-Th-A¹-MBn-A¹-G-C-G¹ | 266 |
| 4149-8_332 | Bn-Bn-A¹-C-Heg-G-Bn-Bn-A-C-C3-C¹-G-C-G-Bn-Pe-Bn-A¹-MBn-A¹-G-C-G¹ | 267 |
| 4149-8_333 | Bn-Bn-A¹-C-Heg-G-Bn-Bn-A-C-C3-C¹-G-C-G-Bn-Pe-Th-A¹-MBn-A¹-G-C-G¹ | 268 |
| 4149-8_334 | Bn-Bn-A¹-C-Heg-G-Bn-Bn-A-C-A¹-C-G-C-G-Bn-Pe-Th-A-Bn-A¹-G-C-G¹-Heg-Heg-Bn-Bn-A¹-C-Heg-G-Bn-Bn-A-C-A¹-C-G-C-G-Bn-Pe-Th-A-Bn-A¹-G-C-G¹ | 269 |
| 4149-8_335 | Bn-Bn-A¹-C-Heg-G-Bn-Bn-A-C-A¹-C-G-C-G-Bn-Pe-Th-A-Bn-A¹-G-C-G¹-Heg-Heg-Heg-Bn-Bn-A¹-C-Heg-G-Bn-Bn-A-C-A¹-C-G-C-G-Bn-Pe-Th-A-Bn-A¹-G-C-G¹ | 270 |
| 4149-8_336 | Bn-Bn-A¹-C-Heg-G-Bn-Bn-A-C-A¹-C-G-C-G-Bn-Pe-Th-A-Bn-A¹-G-C-G¹-Heg-Heg-Heg-Heg-Bn-Bn-A¹-C-Heg-G-Bn-Bn-A-C-A¹-C-G-C-G-Bn-Pe-Th-A-Bn-A¹-G-C-G¹ | 271 |
| 4149-8_337 | Bn-Bn-A¹-C-Heg-G-Bn-Bn-A-C-A¹-C-G-C-G-Bn-Pe-Th-A-Bn-A¹-G-C-G¹-Heg-Heg-Heg-Heg-Heg-Bn-Bn-A¹-C-Heg-G-Bn-Bn-A-C-A¹-C-G-C-G-Bn-Pe-Th-A-Bn-A¹-G-C-G¹ | 272 |
| 4149-8_338 | Bn-Bn-A¹-C-Heg-G-Bn-Bn-A-C-A¹-C-G-C-G-Bn-Pe-Th-A-Bn-A¹-G-C-G¹-Heg-Heg-Heg-Heg-Heg-Heg-Bn-Bn-A¹-C-Heg-G-Bn-Bn-A-C-A¹-C-G-C-G-Bn-Pe-Th-A-Bn-A¹-G-C-G¹ | 273 |
| 4149-8_339 | Bn-Bn-A¹-C-Heg-G-Bn-Bn-A-C-A¹-C-G-C-G-Bn-Pe-Th-A-Bn-A¹-G-C-G¹-C3-(3'-Doubler)-T | 274 |
| 4149-8_340 | Bn-Bn-A¹-C-Heg-G-Bn-Bn-A-C-A¹-C-G-C-G-Bn-Pe-Th-A-Bn-A¹-G-C-G¹-Heg-(3'-Doubler)-T | 275 |
| 4149-8_341 | Bn-Bn-A¹-C-Heg-G-Bn-Bn-A-C-A¹-C-G-C-G-Bn-Pe-Th-A-Bn-A¹-G-C-G¹-Heg-Heg-(3'-Doubler)-T | 276 |
| 4149-8_342 | Bn-Bn-A¹-C-Heg-G-Bn-Bn-A-C-A¹-C-G-C-G-Bn-Pe-Th-A-Bn-A¹-G-C-G¹-Heg-Heg-Heg-(3'-Doubler)-T | 277 |
| 4149-8_343 | Bn-Bn-A¹-C-Heg-G-Bn¹-Bn-A-C-A¹-C¹-G-C-G-Bn-Pe-Bn¹-A¹-Bn-A¹-G-C-G¹ | 278 |
| 4149-8_344 | Bn-Bn-A¹-C-Heg-G°-Bn1-Bn-A-C-A¹-C¹-G-C-G-Bn-Pe-Bn¹-A¹-Bn-A¹-G-C-G¹ | 279 |
| 4149-8_345 | Bn-Bn-A¹-C-Heg-G-Bn¹-Bn-A-C-A¹-C¹-G°-C-G-Bn-Pe-Bn1-A¹-Bn-A¹-G-C-G¹ | 280 |
| 4149-8_346 | Bn-Bn-A¹-C-Heg-G-Bn¹-Bn-A-C-A¹-C¹-G-C-G°-Bn-Pe-Bn1-A¹-Bn-A¹-G-C-G¹ | 281 |
| 4149-8_347 | Bn-Bn-A¹-C-Heg-G-Bn¹-Bn-A-C-A¹-C¹-G-C-G-Bn-Pe-Bn¹-A¹-Bn-A¹-G°-C-G1 | 282 |
| 4149-8_349 | Bn-Bn-A¹-C°-Heg-G-Bn1-Bn-A-C-A¹-C¹-G-C-G-Bn-Pe-Bn¹-A¹-Bn-A¹-G-C-G¹ | 283 |
| 4149-8_352 | Bn-Bn-A¹-C-Heg-G-Bn¹-Bn-A-C-A¹-C¹-G-C-G-Bn-Pe-Bn¹-A¹-Bn-A¹-G-C°-G1 | 284 |
| 4149-8_353 | Bn-Bn-A¹-C-Heg-G-Bn-Bn-A°-C-A1-C¹-G-C-G-Bn-Pe-Bn¹-A¹-Bn-A¹-G-C-G¹ | 285 |
| 4149-8_354 | 2Nap-Bn-A¹-C-Heg-G-Bn-Bn-A-C-A¹-C¹-G-C-G-Bn-Pe-Bn¹-A¹-Bn-A¹-G-C-G¹ | 286 |
| 4149-8_355 | FBn-Bn-A¹-C-Heg-G-Bn-Bn-A-C-A¹-C¹-G-C-G-Bn-Pe-Bn¹-A¹-Bn-A¹-G-C-G¹ | 287 |

TABLE 1-continued

Sequences Representative of the 4149-8_1 and Truncated Variants with $K_d$ values for PDGF of 10 nM or less

| Aptamer ID. No. | Sequence (5'→ 3') | SEQ ID NO. |
|---|---|---|
| 4149-8_356 | NE-Bn-$A^1$-C-Heg-G-Bn-Bn-A-C-$A^1$-$C^1$-G-C-G-Bn-Pe-$Bn^1$-$A^1$-Bn-$A^1$-G-C-$G^1$ | 288 |
| 4149-8_357 | 2NE-Bn-$A^1$-C-Heg-G-Bn-Bn-A-C-$A^1$-$C^1$-G-C-G-Bn-Pe-$Bn^1$-$A^1$-Bn-$A^1$-G-C-$G^1$ | 289 |
| 4149-8_358 | PP-Bn-$A^1$-C-Heg-G-Bn-Bn-A-C-$A^1$-$C^1$-G-C-G-Bn-Pe-$Bn^1$-$A^1$-Bn-$A^1$-G-C-$G^1$ | 290 |
| 4149-8_359 | 1b-Bn-$A^1$-C-Heg-G-Bn-Bn-A-C-$A^1$-$C^1$-G-C-G-Bn-Pe-$Bn^1$-$A^1$-Bn-$A^1$-G-C-$G^1$ | 291 |
| 4149-8_360 | Bn-MBn-$A^1$-C-Heg-G-Bn-Bn-A-C-$A^1$-$C^1$-G-C-G-Bn-Pe-$Bn^1$-$A^1$-Bn-$A^1$-G-C-$G^1$ | 292 |
| 4149-8_361 | T-Bn-$A^1$-C-Heg-G-Bn-Bn-A-C-$A^1$-C-G-C-G-Bn-Bn-Bn-A-Bn-$A^1$-G-C-$G^1$ | 293 |
| 4149-8_362 | Bn-T-$A^1$-C-Heg-G-Bn-Bn-A-C-$A^1$-C-G-C-G-Bn-Bn-Bn-A-Bn-$A^1$-G-C-$G^1$ | 294 |
| 4149-8_363 | Bn-Bn-$A^1$-C-Heg-G-T-Bn-A-C-$A^1$-C-G-C-G-Bn-Bn-Bn-A-Bn-$A^1$-G-C-$G^1$ | 295 |
| 4149-8_369 | Bn-Bn-$A^1$-C-Heg-G-Bn-Bn-$A^2$-C-$A^1$-$C^1$-G-C-G-Bn-Pe-$Bn^1$-$A^1$-Bn-$A^1$-G-C-$G^1$ | 296 |
| 4149-8_370 | Bn-Bn-$A^1$-C-Heg-G-$Bn^1$-Bn-$A^2$-C-$A^1$-$C^1$-G-C-G-Bn-Pe-$Bn^1$-$A^1$-Bn-$A^1$-G-C-$G^1$ | 297 |
| 4149-8_371 | Bn-Bn-$A^1$-C-Heg-G-Bn-Bn-A-C-$A^1$-$C^1$-G-C-$G^2$-Bn-Pe-$Bn^1$-$A^1$-Bn-$A^1$-G-C-$G^1$ | 298 |
| 4149-8_372 | Bn-Bn-$A^1$-C-Heg-G-$Bn^1$-Bn-A-C-$A^1$-$C^1$-G-C-$G^2$-Bn-Pe-$Bn^1$-$A^1$-Bn-$A^1$-G-C-$G^1$ | 299 |
| 4149-8_373 | Bn-Bn-$A^1$-C-Heg-G-Bn-Bn-$A^2$-C-$A^1$-$C^1$-G-C-$G^2$-Bn-Pe-$Bn^1$-$A^1$-Bn-$A^1$-G-C-$G^1$ | 300 |
| 4149-8_374 | Bn-Bn-$A^1$-C-Heg-G-$Bn^1$-Bn-$A^2$-C-$A^1$-$C^1$-G-C-$G^2$-Bn-Pe-$Bn^1$-$A^1$-Bn-$A^1$-G-C-$G^1$ | 301 |
| 4149-8_375 | FBn-Bn-$A^1$-C-Heg-G-$Bn^1$-Bn-A-C-$A^1$-$C^1$-G-C-G-Bn-Bn-$Bn^1$-$A^1$-Bn-$A^1$-G-C-$G^1$ | 302 |
| 4149-8_376 | Bn-MBn-$A^1$-C-Heg-G-$Bn^1$-Bn-A-C-$A^1$-$C^1$-G-C-G-Bn-Bn-$Bn^1$-$A^1$-Bn-$A^1$-G-C-$G^1$ | 303 |
| 4149-8_377 | FBn-MBn-$A^1$-C-Heg-G-$Bn^1$-Bn-A-C-$A^1$-$C^1$-G-C-G-Bn-Bn-$Bn^1$-$A^1$-Bn-$A^1$-G-C-$G^1$ | 304 |
| 4149-8_378 | FBn-Bn-$A^1$-C-Heg-G-$Bn^1$-Bn-A-C-C3-$C^1$-G-C-G-Bn-Bn-$Bn^1$-$A^1$-Bn-$A^1$-G-C-$G^1$ | 305 |
| 4149-8_379 | Bn-MBn-$A^1$-C-Heg-G-$Bn^1$-Bn-A-C-C3-$C^1$-G-C-G-Bn-Bn-$Bn^1$-$A^1$-Bn-$A^1$-G-C-$G^1$ | 306 |
| 4149-8_380 | FBn-MBn-$A^1$-C-Heg-G-$Bn^1$-Bn-A-C-C3-$C^1$-G-C-G-Bn-Bn-$Bn^1$-$A^1$-Bn-$A^1$-G-C-$G^1$ | 307 |
| 4149-8_381 | FBn-Bn-$A^1$-C-Heg-G-$Bn^1$-Bn-A-C-$A^1$-$C^1$-G-C-G-Bn-Pe-$Bn^1$-$A^1$-Bn-$A^1$-G-C-$G^1$ | 308 |
| 4149-8_382 | Bn-MBn-$A^1$-C-Heg-G-$Bn^1$-Bn-A-C-$A^1$-$C^1$-G-C-G-Bn-Pe-$Bn^1$-$A^1$-Bn-$A^1$-G-C-$G^1$ | 309 |
| 4149-8_383 | FBn-MBn-$A^1$-C-Heg-G-$Bn^1$-Bn-A-C-$A^1$-$C^1$-G-C-G-Bn-Pe-$Bn^1$-$A^1$-Bn-$A^1$-G-C-$G^1$ | 310 |
| 4149-8_384 | FBn-Bn-$A^1$-C-Heg-G-$Bn^1$-Bn-A-C-C3-$C^1$-G-C-G-Bn-Pe-$Bn^1$-$A^1$-Bn-$A^1$-G-C-$G^1$ | 311 |
| 4149-8_385 | Bn-MBn-$A^1$-C-Heg-G-$Bn^1$-Bn-A-C-C3-$C^1$-G-C-G-Bn-Pe-$Bn^1$-$A^1$-Bn-$A^1$-G-C-$G^1$ | 312 |

TABLE 1-continued

Sequences Representative of the 4149-8_1 and Truncated Variants with $K_d$ values for PDGF of 10 nM or less

| Aptamer ID. No. | Sequence (5'→ 3') | SEQ ID NO. |
|---|---|---|
| 4149-8_386 | FBn-MBn-A$^1$-C-Heg-G-Bn$^1$-Bn-A-C-C3-C$^1$-G-C-G-Bn-Pe-Bn$^1$-A$^1$-Bn-A$^1$-G-C-G$^1$ | 313 |
| 4149-8_388 | Bn-Bn-A$^1$-C-Heg-G-Bn-Bn-A$^2$-C-A$^1$-C$^1$-G-C-G$^2$-Bn-Bn-Bn$^1$-A$^1$-Bn-A$^1$-G-C-G$^1$ | 314 |
| 4149-8_389 | Bn-Bn-A$^1$-C-Heg-G-Bn$^1$-Bn-A$^2$-C-A$^1$-C$^1$-G-C-G$^2$-Bn-Bn-Bn$^1$-A$^1$-Bn-A$^1$-G-C-G$^1$ | 315 |
| 4149-8_390 | Bn-Bn-A$^1$-C-Heg-G-Bn$^1$-Bn-A$^2$-C-C3-C$^1$-G-C-G$^2$-Bn-Pe-Bn$^1$-A$^1$-Bn-A$^1$-G-C-G$^1$ | 316 |
| 4149-8_391 | Bn-Bn-A$^1$-C-Heg-G-Bn-Bn-A$^2$-C-C3-C$^1$-G-C-G$^2$-Bn-Bn-Bn$^1$-A$^1$-Bn-A$^1$-G-C-G$^1$ | 317 |
| 4149-8_392 | Bn-Bn-A$^1$-C-Heg-G-Bn$^1$-Bn-A$^2$-C-C3-C$^1$-G-C-G$^2$-Bn-Bn-Bn$^1$-A$^1$-Bn-A$^1$-G-C-G$^1$ | 318 |
| 4149-8_393 | FBn-Bn-A$^1$-C-Heg-G-Bn-Bn-A$^2$-C$^1$-A$^1$-C-G-C-G$^2$-Bn-Pe-Bn$^1$-A$^1$-Bn-A$^1$-G-C-G$^1$ | 319 |
| 4149-8_394 | Bn-MBn-A$^1$-C-Heg-G-Bn-Bn-A$^2$-C-A$^1$-C$^1$-G-C-G$^2$-Bn-Pe-Bn$^1$-A$^1$-Bn-A$^1$-G-C-G$^1$ | 320 |
| 4149-8_395 | FBn-MBn-A$^1$-C-Heg-G-Bn-Bn-A$^2$-C-A$^1$-C$^1$-G-C-G$^2$-Bn-Pe-Bn$^1$-A$^1$-Bn-A$^1$-G-C-G$^1$ | 321 |
| 4149-8_396 | FBn-Bn-A$^1$-C-Heg-G-Bn-Bn-A$^2$-C-C3-C$^1$-G-C-G$^2$-Bn-Pe-Bn$^1$-A$^1$-Bn-A$^1$-G-C-G$^1$ | 322 |
| 4149-8_397 | Bn-MBn-A$^1$-C-Heg-G-Bn-Bn-A$^2$-C-C3-C$^1$-G-C-G$^2$-Bn-Pe-Bn$^1$-A$^1$-Bn-A$^1$-G-C-G$^1$ | 323 |
| 4149-8_398 | FBn-MBn-A$^1$-C-Heg-G-Bn-Bn-A$^2$-C-C3-C$^1$-G-C-G$^2$-Bn-Pe-Bn$^1$-A$^1$-Bn-A$^1$-G-C-G$^1$ | 324 |
| 4149-8_399 | FBn-MBn-A$^1$-C-Heg-G-Bn$^1$-Bn-A$^2$-C-C3-C$^1$-G-C-G$^2$-Bn-Bn-Bn$^1$-A$^1$-Bn-A$^1$-G-C-G$^1$ | 325 |
| 4149-8_400 | FBn-MBn-A$^1$-C-Heg-G-Bn$^1$-Bn-A$^2$-C-A$^1$-C$^1$-G-C-G$^2$-Bn-Bn-Bn$^1$-A$^1$-Bn-A$^1$-G-C-G$^1$ | 326 |
| 4149-8_402 | Bn-Bn-A-C-G-A-C-Bn-A-C-G-Bn-Bn-A-C-A-G-C-G--Bn-Bn-Bn-A-Bn-A-G-C | 327 |
| 4149-8_403 | Bn-Bn-A-C-Heg-G-Bn-Bn-A-C-A-G-C-G--Bn-Bn-Bn-A-Bn-A-G-C | 328 |
| 4149-8_404 | Bn-Bn-A-C-Heg-G-Bn-Bn-A-C-C3-G-C-G-Bn-Bn-Bn-A-Bn-A-G-C | 329 |
| 4149-8_418 | Bn-MBn-A$^1$-C-Heg-G-Bn$^1$-Bn-A-C-C3-C$^1$-G-C-G$^1$-Bn-Bn-Bn$^1$-A$^1$-Bn-A$^1$-G-C-G$^1$ | 330 |
| 4149-8_419 | Bn-MBn-A$^1$-C-Heg-G-Bn$^1$-Bn-A-C-C3-C$^1$-G-C-G$^1$-Nap-Bn-Bn$^1$-A$^1$-Bn-A$^1$-G-C-G$^1$ | 331 |
| 4149-8_420 | Bn-MBn-A$^1$-C-Heg-G-Bn$^1$-Bn-A-C-C3-C$^1$-G-C-G$^1$-2Nap-Bn-Bn$^1$-A$^1$-Bn-A$^1$-G-C-G$^1$ | 332 |
| 4149-8_421 | Bn-MBn-A$^1$-C-Heg-G-Bn$^1$-Bn-A-C-C3-C$^1$-G$^1$-C-G-Bn-Bn-Bn$^1$-A$^1$-Bn-A$^1$-G-C-G$^1$ | 333 |
| 4149-8_422 | Bn-MBn-A$^1$-C-Heg-G-Bn$^1$-Bn-A-C-C3-C-G$^1$-C$^1$-G$^1$-Bn-Bn-Bn$^1$-A$^1$-Bn-A$^1$-G-C-G$^1$ | 334 |
| 4149-8_423 | Bn-MBn-A$^1$-C-Heg-G-Bn$^1$-Bn-A-C-C3-C-G$^1$-C$^1$-G-Nap-Bn-Bn$^1$-A$^1$-Bn-A$^1$-G-C-G$^1$ | 335 |
| 4149-8_424 | Bn-MBn-A$^1$-C-Heg-G-Bn$^1$-Bn-A-C-C3-C$^1$-G$^1$-C$^1$-G-Bn-Bn-Bn$^1$-A$^1$-Bn-A$^1$-G-C-G$^1$ | 336 |
| 4149-8_425 | Bn-MBn-A$^1$-C-Heg-G-Bn$^1$-Bn-A$^1$-C-C3-C$^1$-G-C-G-Bn-Bn-Bn$^1$-A$^1$-Bn-A$^1$-G-C-G$^1$ | 337 |
| 4149-8_431 | Bn-MBn-A$^1$-C-Heg-G-Bn$^1$-Bn-A$^2$-C-C3-C$^1$-G-C-G$^2$-Nap-Bn$^2$-Bn$^1$-A$^1$-Bn-A$^1$-G-C-G$^1$ | 338 |

TABLE 1-continued

Sequences Representative of the 4149-8_1 and Truncated Variants with $K_d$ values for PDGF of 10 nM or less

| Aptamer ID. No. | Sequence (5'→ 3') | SEQ ID NO. |
|---|---|---|
| 4149-8_432 | Bn-MBn-$A^1$-C-Heg-G-$Bn^1$-Bn-$A^2$-C-C3-$C^1$-G-C-$G^2$-Bn-$Bn^2$-$Bn^1$-$A^1$-Bn-$A^1$-G-C-$G^1$ | 339 |
| 4149-8_433 | Bn-MBn-$A^1$-C-Heg-G-$Bn^1$-Bn-$A^2$-C-C3-$C^1$-G-C-$G^2$-Nap-Bn-$Bn^1$-$A^1$-Bn-$A^1$-G-C-$G^1$ | 340 |
| 4149-8_434 | Bn-MBn-$A^1$-C-Heg-G-$Bn^1$-Bn-$A^2$-C-C3-$C^1$-G-C-$G^2$-Bn-Bn-$Bn^1$-$A^1$-Bn-$A^1$-G-C-$G^1$ | 341 |
| 4149-8_435 | Bn-Bn-$A^1$-C-Heg-G-$Bn^1$-Bn-$A^2$-C-C3-$C^1$-G-C-$G^2$-Nap-$Bn^2$-$Bn^1$-$A^1$-Bn-$A^1$-G-C-$G^1$ | 342 |
| 4149-8_436 | Bn-Bn-$A^1$-C-Heg-G-$Bn^1$-Bn-$A^2$-C-C3-$C^1$-G-C-$G^2$-Bn-$Bn^2$-$Bn^1$-$A^1$-Bn-$A^1$-G-C-$G^1$ | 343 |
| 4149-8_437 | Bn-Bn-$A^1$-C-Heg-G-$Bn^1$-Bn-$A^2$-C-C3-$C^1$-G-C-$G^2$-Nap-Bn-$Bn^1$-$A^1$-Bn-$A^1$-G-C-$G^1$ | 344 |

No superscript indicates deoxyribose
Superscript o indicates 2'-fluoro
Superscript 1 indicates 2'-O-methyl
Superscript 2 indicates phosphorothioate (deoxyribose)
C3 = three carbon linker
Heg = hexaethylene glycol linker
Nap = naphthyl-dU
Pe = phenethyl-dU
BT = benzothiophenyl-dU
Th = thiophenyl-dU
Ib = isobutyl-dU
Trp = tryptaminyl-dU
2Nap = 2-naphthyl-dU
2NE = 2-naphthylethyl-dU
NE = naphthylethyl-dU
MBn = methylenedioxybenzyl-dU
PP = phenpropyl-dU
Tyr = tyrosyl-dU
FBn = fluorobenzyl-dU
Bn = benzyl-dU
3'-Doubler = Symmetric Doubler Phosphoramidite (Glen Research, Cat# 10-1920-02)

TABLE 1a

Homodimers of PDGF aptamer 4149-8_260 (SL5):

| Seql | Kd (M) | Ratio to 4149-8_38 | SOMAmer (2.5 nM) PDGF-BB (1 nM) duplicates Relative PDGFRb phosphorylation | |
|---|---|---|---|---|
| 4149-8_38 | 3.00E−11 | 1.0 | 5.4% | 3.6% |
| 4149-8_334 | 4.92E−11 | 1.6 | 1.7% | 1.7% |
| 4149-8_335 | 5.46E−11 | 1.8 | 1.5% | 1.5% |
| 4149-8_336 | 1.84E−11 | 0.61 | 1.7% | 2.3% |
| 4149-8_337 | 3.79E−12 | 0.1 | | |
| 4149-8_338 | 2.84E−11 | 0.93 | 1.4% | 1.3% |
| 4149-8_339 3'DBLR | 6.20E−12 | 0.2 | 2.7% | 3.6% |
| 4149-8_340 3'DBLR | 1.89E−11 | 0.6 | 1.7% | 3.2% |
| 4149-8_341 3'DBLR | 2.72E−11 | 0.9 | 1.5% | 1.9% |
| 4149-8_342 3'DBLR | 1.81E−11 | 0.6 | 1.6% | 1.5% |

TABLE 2

Sequences Representative of the Truncated Variants with $K_d$ values for PDGF of more than 10 nM

| Aptamer ID. No. | Sequence (5'→ 3') | SEQ ID NO. |
|---|---|---|
| 4149-8_14 | C-G-A-C-Bn-A-C-G-Bn-Bn-A-C-A-C-G-C-G-Bn-Bn-Bn-A-Bn-A-G-C-G-Bn-C-A-A-C-C-C-G-A-G-Bn-G-A-A-C-A | 345 |
| 4149-8_15 | A-C-Bn-A-C-G-Bn-Bn-A-C-A-C-G-C-G-Bn-Bn-Bn-A-Bn-A-G-C-G-Bn-C-A-A-C-C-C-G-A-G-Bn-G-A-A-C-A | 346 |

TABLE 2-continued

Sequences Representative of the Truncated Variants with $K_d$ values for PDGF of more than 10 nM

| Aptamer ID. No. | Sequence (5'→ 3') | SEQ ID NO. |
|---|---|---|
| 4149-8_16 | Bn-A-C-G-Bn-Bn-A-C-A-C-G-C-G-Bn-Bn-Bn-A-Bn-A-G-C-G-Bn-C-A-A-C-C-C-G-A-G-Bn-G-A-A-C-A | 347 |
| 4149-8_17 | C-G-Bn-Bn-A-C-A-C-G-C-G-Bn-Bn-Bn-A-Bn-A-G-C-G-Bn-C-A-A-C-C-C-G-A-G-Bn-G-A-A-C-A | 348 |
| 4149-8_18 | Bn-Bn-A-C-A-C-G-C-G-Bn-Bn-Bn-A-Bn-A-G-C-G-Bn-C-A-A-C-C-C-G-A-G-Bn-G-A-A-C-A | 349 |
| 4149-8_19 | A-C-A-C-G-C-G-Bn-Bn-Bn-A-Bn-A-G-C-G-Bn-C-A-A-C-C-C-G-A-G-Bn-G-A-A-C-A | 350 |
| 4149-8_33 | C-Bn-Bn-A-C-G-A-C-Bn-A-C-G-Bn-Bn-A-C-A-C-G-C-G-Bn-Bn-Bn-A-Bn-A | 351 |
| 4149-8_34 | C-Bn-Bn-A-C-G-A-C-Bn-A-C-G-Bn-Bn-A-C-A-C-G-C-G-Bn-Bn-Bn-A-T | 352 |
| 4149-8_35 | C-Bn-Bn-A-C-G-A-C-Bn-A-C-G-Bn-Bn-A-C-A-C-G-C-G-Bn-Bn-Bn-A | 353 |
| 4149-8_41 | Bn-Bn-A-C-G-A-C-Bn-A-C-G-Bn-Bn-A-C-A-C-G-C-G-Bn-Bn-Bn-A-Bn-A | 354 |
| 4149-8_42 | Bn-Bn-A-C-G-A-C-Bn-A-C-G-Bn-Bn-A-C-A-C-G-C-G-Bn-Bn-Bn-A-T | 355 |
| 4149-8_43 | Bn-Bn-A-C-G-A-C-Bn-A-C-G-Bn-Bn-A-C-A-C-G-C-G-Bn-Bn-Bn-A | 356 |
| 4149-8_65 | Bn-C3-A-C-G-A-C-Bn-A-C-G-Bn-Bn-A-C-A-C-G-C-G-Bn-Bn-Bn-A-Bn-A-G-C-G | 357 |
| 4149-8_66 | Bn-Bn-C3-C-G-A-C-Bn-A-C-G-Bn-Bn-A-C-A-C-G-C-G-Bn-Bn-Bn-A-Bn-A-G-C-G | 358 |
| 4149-8_74 | Bn-Bn-A-C-G-A-C-Bn-A-C3-Bn-Bn-A-C-A-C-G-C-G-Bn-Bn-Bn-A-Bn-A-G-C-G | 359 |
| 4149-8_75 | Bn-Bn-A-C-G-A-C-Bn-A-C-G-C3-Bn-A-C-A-C-G-C-G-Bn-Bn-Bn-A-Bn-A-G-C-G | 360 |
| 4149-8_76 | Bn-Bn-A-C-G-A-C-Bn-A-C-G-Bn-C3-A-C-A-C-G-C-G-Bn-Bn-Bn-A-Bn-A-G-C-G | 361 |
| 4149-8_77 | Bn-Bn-A-C-G-A-C-Bn-A-C-G-Bn-Bn-C3-C-A-C-G-C-G-Bn-Bn-Bn-A-Bn-A-G-C-G | 362 |
| 4149-8_81 | Bn-Bn-A-C-G-A-C-Bn-A-C-G-Bn-Bn-A-C-A-C-C3-C-G-Bn-Bn-Bn-A-Bn-A-G-C-G | 363 |
| 4149-8_82 | Bn-Bn-A-C-G-A-C-Bn-A-C-G-Bn-Bn-A-C-A-C-G-C3-G-Bn-Bn-Bn-A-Bn-A-G-C-G | 364 |
| 4149-8_83 | Bn-Bn-A-C-G-A-C-Bn-A-C-G-Bn-Bn-A-C-A-C-G-C-C3-Bn-Bn-Bn-A-Bn-A-G-C-G | 365 |
| 4149-8_84 | Bn-Bn-A-C-G-A-C-Bn-A-C-G-Bn-Bn-A-C-A-C-G-C-G-C3-Bn-Bn-A-Bn-A-G-C-G | 366 |
| 4149-8_85 | Bn-Bn-A-C-G-A-C-Bn-A-C-G-Bn-Bn-A-C-A-C-G-C-G-Bn-C3-Bn-A-Bn-A-G-C-G | 367 |
| 4149-8_86 | Bn-Bn-A-C-G-A-C-Bn-A-C-G-Bn-Bn-A-C-A-C-G-C-G-Bn-Bn-C3-A-Bn-A-G-C-G | 368 |
| 4149-8_88 | Bn-Bn-A-C-G-A-C-Bn-A-C-G-Bn-Bn-A-C-A-C-G-C-G-Bn-Bn-Bn-A-C3-A-G-C-G | 369 |
| 4149-8_89 | Bn-Bn-A-C-G-A-C-Bn-A-C-G-Bn-Bn-A-C-A-C-G-C-G-Bn-Bn-Bn-A-Bn-C3-G-C-G | 370 |
| 4149-8_90 | Bn-Bn-A-C-G-A-C-Bn-A-C-G-Bn-Bn-A-C-A-C-G-C-G-Bn-Bn-Bn-A-Bn-A-C3-C-G | 371 |

TABLE 2-continued

Sequences Representative of the Truncated Variants with $K_d$ values for PDGF of more than 10 nM

| Aptamer ID. No. | Sequence (5'→ 3') | SEQ ID NO. |
|---|---|---|
| 4149-8_102 | Bn-Bn-A$^1$-C-G-C3-C-C3-C3-C-G-Bn-Bn-A-C-A$^1$-C-G-C-G-Bn-Bn-Bn-A-Bn-A$^1$-G-C-G$^1$ | 372 |
| 4149-8_104 | Bn-U$^1$-A-C-G-A-C-Bn-A-C-G-Bn-Bn-A-C-A-C-G-C-G-Bn-Bn-Bn-A-Bn-A-G-C-G | 373 |
| 4149-8_107 | Bn-Bn-A-C-G-A-C-Bn-A-C-G-Bn-U$^1$-A-C-A-C-G-C-G-Bn-Bn-Bn-A-Bn-A-G-C-G | 374 |
| 4149-8_108 | Bn-Bn-A-C-G-A-C-Bn-A-C-G-Bn-Bn-A-C-A-C-G-C-G-U$^1$-Bn-Bn-A-Bn-A-G-C-G | 375 |
| 4149-8_109 | Bn-Bn-A-C-G-A-C-Bn-A-C-G-Bn-Bn-A-C-A-C-G-C-G-Bn-U$^1$-Bn-A-Bn-A-G-C-G | 376 |
| 4149-8_111 | Nap-Bn-A-C-G-A-C-Bn-A-C-G-Bn-Bn-A-C-A-C-G-C-G-Bn-Bn-Bn-A-U$^1$-A-G-C-G | 377 |
| 4149-8_127 | Bn-Nap-A-C-Heg-Heg-G-U$^1$-Nap-A-C-A-C-G-C-G-Nap-Nap-Bn-A-Nap-A-G-C-G | 378 |
| 4149-8_129 | Bn-Nap-A$^1$-C-Heg-Heg-G-U$^1$-Nap-A-C-A$^1$-C-G-C-G-Nap-Nap-Bn-A-Nap-A$^1$-G-C-G$^1$ | 379 |
| 4149-8_134 | Bn-Bn-A-C-G-Bn-Bn-A-C-A-C-G-C-G-Bn-Bn-Bn-A-Bn-A-G-C-G | 380 |
| 4149-8_178 | Bn-Bn-A$^1$-C-Heg-G-Bn-Trp-A-C-A$^1$-C-G-C-G-Bn-Bn-Bn-A-Bn-A$^1$-G-C-G$^1$ | 381 |
| 4149-8_179 | Bn-Bn-A$^1$-C-Heg-G-Bn-Bn-A-C-A$^1$-C-G-C-G-Trp-Bn-Bn-A-Bn-A$^1$-G-C-G$^1$ | 382 |
| 4149-8_180 | Bn-Bn-A$^1$-C-Heg-G-Bn-Bn-A-C-A$^1$-C-G-C-G-Bn-Trp-Bn-A-Bn-A$^1$-G-C-G$^1$ | 383 |
| 4149-8_186 | Bn-Bn-A$^1$-C-Heg-G-Bn-2Nap-A-C-A$^1$-C-G-C-G-Bn-Bn-Bn-A-Bn-A$^1$-G-C-G$^1$ | 384 |
| 4149-8_196 | Bn-Bn-A$^1$-C-Heg-G-Bn-Bn-A-C-A$^1$-C-G-C-G-Bn-2NE-Bn-A-Bn-A$^1$-G-C-G$^1$ | 385 |
| 4149-8_244 | Bn-Bn-A$^1$-C-Heg-G-Bn-Bn-A$^1$-C-A$^1$-C-G-C-G-Bn-Bn-Bn-A-Bn-A$^1$-G-C-G$^1$ | 386 |
| 4149-8_250 | Tyr-MBn-A$^1$-C-Heg-G-FBn-Ib-A-C-A$^1$-C-G-C-G-2Nap-Pe-Th-A-NE-A$^1$-G-C-G$^1$ | 387 |
| 4149-8_251 | Tyr-MBn-A$^1$-C-Heg-G-FBn-Ib-A-C-A$^1$-C-G-C-G-2Nap-Pe-Th-A$^1$-NE-A$^1$-G$^1$-C-G$^1$ | 388 |
| 4149-8_252 | Trp-Ib-A$^1$-C-Heg-G-NE-Ib-A-C-A$^1$-C-G-C-G-Th-Pe-Th-A-MBn-A$^1$-G-C-G$^1$ | 389 |
| 4149-8_253 | Trp-Ib-A$^1$-C-Heg-G-NE-Ib-A-C-A$^1$-C-G-C-G-Th-Pe-Th-A$^1$-MBn-A$^1$-G$^1$-C-G$^1$ | 390 |
| 4149-8_258 | Bn-Bn-A$^1$-C-Heg-G-1P-Ib-A-C-A$^1$-C-G-C-G-Bn-Bn-Bn-A-Bn-A$^1$-G-C-G$^1$ | 391 |
| 4149-8_276 | Bn-Bn-A$^1$-C-Heg-G-FBn-Ib-A-C-A$^1$-C-G-C-G-Bn-Pe-Th-A-Bn-A$^1$-G-C-G$^1$ | 392 |
| 4149-8_277 | Tyr-Bn-A$^1$-C-Heg-G-Bn-Ib-A-C-A$^1$-C-G-C-G-Bn-Pe-Th-A-Bn-A$^1$-G-C-G$^1$ | 393 |
| 4149-8_278 | Tyr-Bn-A$^1$-C-Heg-G-FBn-Ib-A-C-A$^1$-C-G-C-G-2Nap-Pe-Th-A-Bn-A$^1$-G-C-G$^1$ | 394 |
| 4149-8_304 | Bn-Bn-A$^1$-C-C3-G-Bn-Bn-A-C-C3--G-C-G-Bn-Bn-Bn-A-Bn-A$^1$-G-C-G$^1$ | 395 |
| 4149-8_305 | Bn$^1$-Bn-A$^1$-C-Heg-G-Bn-Bn-A-C-A$^1$-C-G-C-G-Bn-Bn-Bn-A-Bn-A$^1$-G-C-G$^1$ | 396 |

TABLE 2-continued

Sequences Representative of the Truncated Variants with $K_d$ values for PDGF of more than 10 nM

| Aptamer ID. No. | Sequence (5'→ 3') | SEQ ID NO. |
|---|---|---|
| 4149-8_306 | Bn-Bn$^1$-A$^1$-C-Heg-G-Bn-Bn-A-C-A$^1$-C-G-C-G-Bn-Bn-A-Bn-A$^1$-G-C-G$^1$ | 397 |
| 4149-8_309 | Bn-Bn-A$^1$-C-Heg-G-Bn-Bn-A-C-A$^1$-C-G-C-G-Bn$^1$-Bn-Bn-A-Bn-A$^1$-G-C-G$^1$ | 398 |
| 4149-8_310 | Bn-Bn-A$^1$-C-Heg-G-Bn-Bn-A-C-A$^1$-C-G-C-G-Bn-Bn$^1$-Bn-A-Bn-A$^1$-G-C-G$^1$ | 399 |
| 4149-8_348 | Bn-Bn-A$^1$-C-Heg-G-Bn$^1$-Bn-A$^o$-C-A$^1$-C-G-C-G-Bn-Pe-Bn$^1$-A$^1$-Bn-A$^1$-G-C-G$^1$ | 400 |
| 4149-8_350 | Bn-Bn-A$^1$-C-Heg-G-Bn$^1$-Bn-A-C$^o$-A$^1$-C$^1$-G-C-G-Bn-Pe-Bn$^1$-A$^1$-Bn-A$^1$-G-C-G$^1$ | 401 |
| 4149-8_351 | Bn-Bn-A$^1$-C-Heg-G-Bn$^1$-Bn-A-C-A$^1$-C$^1$-G-C$^o$-G-Bn-Pe-Bn$^1$-A$^1$-Bn-A$^1$-G-C-G$^1$ | 402 |
| 4149-8_364 | Bn-Bn-A$^1$-C-Heg-G-Bn-T-A-C-A$^1$-C-G-C-G-Bn-Bn-A-Bn-A$^1$-G-C-G$^1$ | 403 |
| 4149-8_365 | Bn-Bn-A$^1$-C-Heg-G-Bn-Bn-A-C-A$^1$-C-G-C-T-Bn-Bn-A-Bn-A$^1$-G-C-G$^1$ | 404 |
| 4149-8_366 | Bn-Bn-A$^1$-C-Heg-G-Bn-Bn-A-C-A$^1$-C-G-C-G-Bn-T-A-Bn-A$^1$-G-C-G$^1$ | 405 |
| 4149-8_367 | Bn-Bn-A$^1$-C-Heg-G-Bn-Bn-A-C-A$^1$-C-G-C-G-Bn-Bn-T-A-Bn-A$^1$-G-C-G$^1$ | 406 |
| 4149-8_368 | Bn-Bn-A$^1$-C-Heg-G-Bn-Bn-A-C-A$^1$-C-G-C-G-Bn-Bn-Bn-A-T-A$^1$-G-C-G$^1$ | 407 |
| 4149-8_405 | Bn-Bn-A-C-Heg-G-Bn-Bn-A-C-C3-C-G-Bn-Bn-Bn-A-Bn-A-G | 408 |
| 4149-8_426 | Bn-MBn-A$^1$-C-Heg-G-Bn$^1$-Bn-A$^1$-C-C3-C$^1$-G-C-G$^1$-Bn-Bn$^1$-A$^1$-Bn-A$^1$-G-C-G$^1$ | 409 |

No superscript indicates deoxyribose
Superscript o indicates 2'-fluoro
Superscript 1 indicates 2'-O-methyl
Superscript 2 indicates phosphorothioate (deoxyribose)
C3 = three carbon linker
Heg = hexaethylene glycol linker
Nap = naphthyl-dU
Pe = phenethyl-dU
BT = benzothiophenyl-dU
Th = thiophenyl-dU
Ib = isobutyl-dU
Trp = tryptaminyl-dU
2Nap = 2-naphthyl-dU
2NE = 2-naphthylethyl-dU
NE = naphthylethyl-dU
MBn = methylenedioxybenzyl-dU
PP = phenpropyl-dU
Tyr = tyrosyl-dU
FBn = fluorobenzyl-dU
Bn = benzyl-dU

TABLE 3

Truncations of PDGF aptamer Clone 4149-8_1.

| Aptamer ID. No. | Sequence (5'→ 3') | Length | $K_d$ (nM) | Seq. ID. NO. |
|---|---|---|---|---|
| 4149-8_2 | A-T-C-T-C-Z-Z-A-C-G-A-C-Z-A-C-G-Z-Z-A-C-A-C-G-C-G-Z-Z-Z-A-Z-A-G-C-G-Z-C-A-A-C-C-G-A-G-Z-G-A-A-C-A | 50 | 0.05 | 2 |
| 4149-8_5 | A-T-C-T-C-Z-Z-A-C-G-A-C-Z-A-C-G-Z-Z-A-C-A-C-G-C-G-Z-Z-Z-A-Z-A-G-C-G-Z-C-A-A-C-C-G-A-G-Z-G | 46 | 0.02 | 4 |

TABLE 3-continued

Truncations of PDGF aptamer Clone 4149-8_1.

| Aptamer ID. No. | Sequence (5'→ 3') | Length | K$_d$ (nM) | Seq. ID. NO. |
|---|---|---|---|---|
| 4149-8_7 | A-T-C-T-C-Z-Z-A-C-G-A-C-Z-A-C-G-Z-Z-A-C-A-C-G-C-G-Z-Z-Z-A-Z-A-G-C-G-Z-C-A-A-C-C-C-G | 42 | 0.02 | 6 |
| 4149-8_9 | A-T-C-T-C-Z-Z-A-C-G-A-C-Z-A-C-G-Z-Z-A-C-A-C-G-C-G-Z-Z-Z-A-Z-A-G-C-G-Z-C-A-A | 38 | 0.03 | 8 |
| 4149-8_10 | A-T-C-T-C-Z-Z-A-C-G-A-C-Z-A-C-G-Z-Z-A-C-A-C-G-C-G-Z-Z-Z-A-Z-A-G-C-G-Z-C | 36 | 0.05 | 9 |
| 4149-8_11 | C-T-C-Z-Z-A-C-G-A-C-Z-A-C-G-Z-Z-A-C-A-C-G-C-G-Z-Z-Z-A-Z-A-G-C-G-Z-C-A-A-C-C-C-G-A-G-Z-G-A-A-C-A | 48 | 0.03 | 10 |
| 4149-8_12 | C-Z-Z-A-C-G-A-C-Z-A-C-G-Z-Z-A-C-A-C-G-C-G-Z-Z-Z-A-Z-A-G-C-G-Z-C-A-A-C-C-C-G-A-G-Z-G-A-A-C-A | 46 | 0.04 | 11 |
| 4149-8_13 | Z-A-C-G-A-C-Z-A-C-G-Z-Z-A-C-A-C-G-C-G-Z-Z-Z-A-Z-A-G-C-G-Z-C-A-A-C-C-C-G-A-G-Z-G-A-A-C-A | 44 | 0.8 | 12 |
| 4149-8_14 | C-G-A-C-Z-A-C-G-Z-Z-A-C-A-C-G-C-G-Z-Z-Z-A-Z-A-G-C-G-Z-C-A-A-C-C-C-G-A-G-Z-G-A-A-C-A | 42 | 13 | 345 |
| 4149-8_16 | Z-A-C-G-Z-Z-A-C-A-C-G-C-G-Z-Z-Z-A-Z-A-G-C-G-Z-C-A-A-C-C-C-G-A-G-Z-G-A-A-C-A | 38 | 22 | 347 |
| 4149-8_18 | Z-Z-A-C-A-C-G-C-G-Z-Z-Z-A-Z-A-G-C-G-Z-C-A-A-C-C-C-G-A-G-Z-G-A-A-C-A | 34 | 13 | 349 |
| 4149-8_19 | A-C-A-C-G-C-G-Z-Z-Z-A-Z-A-G-C-G-Z-C-A-A-C-C-C-G-A-G-Z-G-A-A-C-A | 32 | 74 | 350 |
| 4149-8_26 | C-Z-Z-A-C-G-A-C-Z-A-C-G-Z-Z-A-C-A-C-G-C-G-Z-Z-Z-A-Z-A-G-C-G-Z-C-A-A-C-C-C-G-A | 39 | 0.08 | 19 |
| 4149-8_27 | C-T-C-Z-Z-A-C-G-A-C-Z-A-C-G-Z-Z-A-C-A-C-G-C-G-Z-Z-Z-A-Z-A-G-C-G-Z-C | 34 | 0.09 | 20 |
| 4149-8_29 | C-Z-Z-A-C-G-A-C-Z-A-C-G-Z-Z-A-C-A-C-G-C-G-Z-Z-Z-A-Z-A-G-C-G-T | 31 | 0.07 | 22 |
| 4149-8_30 | C-Z-Z-A-C-G-A-C-Z-A-C-G-Z-Z-A-C-A-C-G-C-G-Z-Z-Z-A-Z-A-G-C-G | 30 | 0.07 | 23 |
| 4149-8_31 | C-Z-Z-A-C-G-A-C-Z-A-C-G-Z-Z-A-C-A-C-G-C-G-Z-Z-Z-A-Z-A-G-C | 29 | 0.30 | 24 |
| 4149-8_32 | C-Z-Z-A-C-G-A-C-Z-A-C-G-Z-Z-A-C-A-C-G-C-G-Z-Z-Z-A-Z-A-G | 28 | 6 | 25 |
| 4149-8_33 | C-Z-Z-A-C-G-A-C-Z-A-C-G-Z-Z-A-C-A-C-G-C-G-Z-Z-Z-A-Z-A | 27 | >1000 | 351 |
| 4149-8_37 | Z-Z-A-C-G-A-C-Z-A-C-G-Z-Z-A-C-A-C-G-C-G-Z-Z-Z-A-Z-A-G-C-G-T | 30 | 0.04 | 27 |
| 4149-8_38 | Z-Z-A-C-G-A-C-Z-A-C-G-Z-Z-A-C-A-C-G-C-G-Z-Z-Z-A-Z-A-G-C-G | 29 | 0.05 | 28 |
| 4149-8_39 | Z-Z-A-C-G-A-C-Z-A-C-G-Z-Z-A-C-A-C-G-C-G-Z-Z-Z-A-Z-A-G-C | 28 | .11 | 29 |
| 4149-8_40 | Z-Z-A-C-G-A-C-Z-A-C-G-Z-Z-A-C-A-C-G-C-G-Z-Z-Z-A-Z-A-G | 27 | 1.5 | 30 |
| 4149-8_41 | Z-Z-A-C-G-A-C-Z-A-C-G-Z-Z-A-C-A-C-G-C-G-Z-Z-Z-A-Z-A | 26 | >1000 | 354 |

TABLE 4

Data-collection, refinement and model statistics.

| Ligand | 4149-8_260 | 4149-8_255 |
|---|---|---|
| DATA COLLECTION | | |
| Space group | $P4_12_12$ | $P4_12_12$ |
| Unit-cell parameters: a, b, c (Å) | 59.10, 59.10, 167.01 | 59.40, 59.40 168.2 |
| Wavelength (Å) | 0.97918 | 0.97918 |
| Resolution range (Å) | 50.0-2.20 (2.26-2.20) | 50.0-2.30 (2.36-2.30) |
| Unique reflections | 15629 | 13750 |
| Completeness (%) | 96.8 (99.1) | 97.2 (98.4) |
| $R_{merge}$ | 4.0 (57.8) | 6.4 (57.2) |
| Mean I/σ(I) | 25.3 (3.4) | 19.3 (2.6) |
| REFINEMENT | | |
| Resolution range (Å) | 50.0-2.20 (2.26-2.20) | 50.0-2.30 (2.36-2.30) |
| $R_{cryst}$ | 0.225 (0.329) | 0.239 (0.366) |
| $R_{free}$ | 0.262 (0.353) | 0.279 (0.526) |
| R.m.s.d. bonds (Å) | 0.018 | 0.018 |
| R.m.s.d. angles (°) | 1.882 | 2.017 |
| Total atoms | 1382 | 1355 |
| Mean B factor (Å$^2$) | 43.68 | 43.86 |
| Residues in favored region (%) | 98.9 | 98.9 |
| Residues in allowed region (%) | 100.0 | 100.0 |
| Molprobity score (percentile) | 1.45 (99$^{th}$) | 1.41 (99$^{th}$) |
| PDB ID | 4HQU | 4HQX |

Values in parenthesis indicate the values for the highest of twenty resolution shells
$R_{merge} = \Sigma_h \Sigma_i |I_i(h) - <I(h)>|/\Sigma_h \Sigma_i I_i(h)$
$R_{free} = \Sigma_h ||F_{obs}| - |F_{calc}||/\Sigma_h |F_{obs}|$.
The free R factor was calculated using 5% of the reflections omitted from the refinement (The CCP4 suite: programs for protein crystallography, 1994).
*Ligand B-factors are for ligands in the active sites of the protein monomers. Ligands from solvent (PEG, glycerol, etc.) were not included in the calculation.

TABLE 5

Base-pair parameters for the PDGF BB aptamer compared to B-form DNA.

| Parameter | B-DNA | 5'Stem loop | | Miniknot S1 | | Miniknot S2 | |
|---|---|---|---|---|---|---|---|
| Complementary base-pair parameters | | | | | | | |
| Buckle (deg.) | 0.5$_{(6.7)}$ | −5.67$_{(7.90)}$ | | 0.32$_{(22.8)}$ | | −0.74$_{(15.3)}$ | |
| Propeller (deg.) | −11.4$_{(5.3)}$ | −9.84$_{(6.10)}$ | | 7.43$_{(10.4)}$ | | 2.42$_{(7.75)}$ | |
| Opening (deg.) | 0.60$_{(3.1)}$ | −8.13$_{(25.2)}$ | | 7.86$_{(12.5)}$ | | 0.35$_{(0.40)}$ | |
| Shear (Å) | 0.00$_{(0.21)}$ | 1.12$_{(1.42)}$ | | 1.29$_{(2.52)}$ | | −0.03$_{(0.42)}$ | |
| Stretch (Å) | −0.15$_{(0.12)}$ | −0.38$_{(0.66)}$ | | 1.96$_{(3.55)}$ | | −0.12$_{(0.42)}$ | |
| Stagger (Å) | 0.09$_{(0.19)}$ | 0.04$_{(0.61)}$ | | −0.45$_{(0.69)}$ | | 0.28$_{(0.05)}$ | |
| Base-pair step parameters | | U2, A3/ U7, U8 | A3, C4/ G6, U7 | C10, A9/ U16, G15 | A9, U20/ U17, U16 | C12, G13/ C23, G24 | G13, C14/ G22, C23 |
| Tilt (deg.) | −0.1$_{(2.5)}$ | −0.80 | −1.45 | −4.65 | −5.83 | −2.39 | 3.86 |
| Roll (deg.) | 0.6$_{(5.2)}$ | 0.34 | 0.55 | 6.12 | −5.64 | 4.19 | 3.94 |
| Twist (deg.) | 36$_{(6.8)}$ | 24.1 | 33.3 | 25.3 | 15.9 | 29 | 33.9 |
| Shift (Å) | −0.02$_{(0.45)}$ | 3.20 | −0.12 | −0.90 | −1.45 | −0.17 | 0.78 |
| Slide (Å) | 0.23$_{(0.81)}$ | 0.25 | −0.24 | 0.27 | −4.49 | 0.21 | −0.4 |
| Rise (Å) | 3.32$_{(0.19)}$ | 2.68 | 3.28 | 2.98 | 3.58 | 2.73 | 3.13 |
| Local helical parameters | | | | | | | |
| Inclination (deg.) | 2.1$_{(9.2)}$ | 0.81 | 0.96 | 13.6 | −18.9 | 8.28 | 6.72 |
| Tip (deg.) | 0.0$_{(4.3)}$ | 1.92 | 2.52 | 10.4 | 19.5 | 4.72 | −6.57 |
| Helical twist (deg.) | 36.5$_{(6.6)}$ | 24.1 | 33.4 | 26.3 | 17.8 | 29.4 | 34.3 |
| x-displacement (Å) | 0.05$_{(1.28)}$ | 0.52 | −0.5 | −0.97 | −9.84 | −0.34 | −1.28 |
| y-displacement (Å) | 0.02$_{(0.87)}$ | −7.89 | −0.03 | 0.81 | −0.12 | −0.09 | −0.73 |
| Helical rise (Å) | 3.29$_{(0.21)}$ | 2.58 | 3.28 | 3.07 | 5.08 | 2.73 | 3.13 |

TABLE 6

Truncations of PDGF aptamer clone 5169-4.

| Aptamer ID. No. | Sequence (5'→3') | $K_d$ (nM) | Seq. ID. NO. |
|---|---|---|---|
| 5169-4_3 | C-T-G-C-C-P-C-G-A-C-A-G-C-A-P-G-P-A-P-G-C-A-P-C-P-A-G-A-G-G-C-P-A-C-C-C-A-G-P-G-A-A-P-G-A-G-G-A | 0.029 | 410 |
| 5169-4_4 | C-C-P-C-G-A-C-A-G-C-A-P-G-P-A-P-G-C-A-C-A-P-C-P-A-G-A-G-G-C-P-A-C-C-C-A-G-P-G-A-A-P-G-A-G-G-A | 0.027 | 411 |
| 5169-4_5 | C-G-A-C-A-G-C-A-P-G-P-A-P-G-C-A-C-A-P-C-P-A-G-A-G-G-C-P-A-C-C-C-A-G-P-G-A-A-P-G-A-G-G-A | 0.031 | 412 |

TABLE 6-continued

Truncations of PDGF aptamer clone 5169-4.

| Aptamer ID. No. | Sequence (5'→3') | $K_d$ (nM) | Seq. ID. NO. |
|---|---|---|---|
| 5169-4_6 | C-A-G-C-A-P-G-P-A-P-G-C-A-C-A-P-C-P-A-G-A-G-G-C-P-A-C-C-C-A-G-P-G-A-A-P-G-A-G-G-A | 67 | 413 |
| 5169-4_7 | C-T-G-C-C-P-C-G-A-C-A-G-C-A-P-G-P-A-P-G-C-A-C-A-P-C-P-A-G-A-G-G-C-P-A-C-C-C-A-G-P-G-A-A-P-G-A | 0.014 | 414 |
| 5169-4_8 | C-T-G-C-C-P-C-G-A-C-A-G-C-A-P-G-P-A-P-G-C-A-C-A-P-C-P-A-G-A-G-G-C-P-A-C-C-C-A-G-P-G-A-A | 0.036 | 415 |
| 5169-4_9 | C-T-G-C-C-P-C-G-A-C-A-G-C-A-P-G-P-A-P-G-C-A-C-A-P-C-P-A-G-A-G-G-C-P-A-C-C-C-A-G-P | 0.72 | 416 |
| 5169-4_10 | C-T-G-C-C-P-C-G-A-C-A-G-C-A-P-G-P-A-P-G-C-A-C-A-P-C-P-A-G-A-G-G-C-P-A-C-C-C | 0.63 | 417 |
| 5169-4_11 | C-T-G-C-C-P-C-G-A-C-A-G-C-A-P-G-P-A-P-G-C-A-C-A-P-C-P-A-G-A-G-G-C-P-A | 0.60 | 418 |
| 5169-4_12 | C-G-A-C-A-G-C-A-P-G-P-A-P-G-C-A-C-A-P-C-P-A-G-A-G-G-C-P-A-C-C-C-A-G-P-G-A-A | 0.064 | 419 |
| 5169-4_13 | G-A-C-A-G-C-A-P-G-P-A-P-G-C-A-C-A-P-C-P-A-G-A-G-G-C-P-A-C-C-C-A-G-P-G-A-A | 0.027 | 420 |
| 5169-4_14 | A-C-A-G-C-A-P-G-P-A-P-G-C-A-C-A-P-C-P-A-G-A-G-G-C-P-A-C-C-C-A-G-P-G-A-A | 0.17 | 421 |
| 5169-4_15 | C-G-A-C-A-G-C-A-P-G-P-A-P-G-C-A-C-A-P-C-P-A-G-A-G-G-C-P-A-C-C-C-A-G-P-G-A | 0.019 | 422 |
| 5169-4_16 | C-G-A-C-A-G-C-A-P-G-P-A-P-G-C-A-C-A-P-C-P-A-G-A-G-G-C-P-A-C-C-C-A-G-P-G | 0.016 | 423 |
| 5169-4_17 | C-G-A-C-A-G-C-A-P-G-P-A-P-G-C-A-C-A-P-C-P-A-G-A-G-G-C-P-A-C-C-C-A-G-P | 0.020 | 424 |
| 5169-4_18 | C-G-A-C-A-G-C-A-P-G-P-A-P-G-C-A-C-A-P-C-P-A-G-A-G-G-C-P-A | 0.026 | 425 |
| 5169-4_19 | C-G-A-C-A-G-C-A-P-G-P-A-P-G-C-A-C-A-P-C-P-A-G-A-G-G-C-P | 0.012 | 426 |
| 5169-4_20 | C-G-A-C-A-G-C-A-P-G-P-A-P-G-C-A-C-A-P-C-P-A-G-A-G-G-C | 0.014 | 427 |
| 5169-4_21 | C-G-A-C-A-G-C-A-P-G-P-A-P-G-C-A-C-A-P-C-P-A-G-A-G-G | 0.021 | 428 |
| 5169-4_22 | C-G-A-C-A-G-C-A-P-G-P-A-P-G-C-A-C-A-P-C-P-A-G-A-G | 0.015 | 429 |
| 5169-4_23 | C-G-A-C-A-G-C-A-P-G-P-A-P-G-C-A-C-A-P-C-P-A-G-A | 0.020 | 430 |
| 5169-4_24 | C-G-A-C-A-G-C-A-P-G-P-A-P-G-C-A-C-A-P-C-P-A-G | 0.021 | 431 |
| 5169-4_25 | C-G-A-C-A-G-C-A-P-G-P-A-P-G-C-A-C-A-P-C-P-A | 0.020 | 432 |
| 5169-4_26 | C-G-A-C-A-G-C-A-P-G-P-A-P-G-C-A-C-A-P-C-P | 0.017 | 433 |
| 5169-4_27 | G-A-C-A-G-C-A-P-G-P-A-P-G-C-A-C-A-P-C-P-A-G-A | 0.062 | 434 |

TABLE 6-continued

Truncations of PDGF aptamer clone 5169-4.

| Aptamer ID. No. | Sequence (5'→3') | $K_d$ (nM) | Seq. ID. NO. |
|---|---|---|---|
| 5169-4_28 | G-A-C-A-G-C-A-P-G-P-A-P-G-C-A-C-A-P-C-P-A-G | 0.048 | 435 |
| 5169-4_29 | G-A-C-A-G-C-A-P-G-P-A-P-G-C-A-C-A-P-C-P-A | 0.062 | 436 |
| 5169-4_30 | G-A-C-A-G-C-A-P-G-P-A-P-G-C-A-C-A-P-C-P | 0.062 | 437 |
| 5169-4_32 | G-A-C-A-G-C-A-P-G-P-A-P-G-C-A-C-A-P-C-P-A-G-A-G | 0.053 | 438 |

TABLE 7

C3 spacer substitutions at all positions in 5169-4_26.

| Aptamer ID. No. | Sequence (5'→3') | $K_d$ (nM) | Seq. ID. NO. |
|---|---|---|---|
| 5169-4_59 | C3-G-A-C-A-G-C-A-P-G-P-A-P-G-C-A-C-A-P-C-P | 0.053 | 439 |
| 5169-4_60 | C-C3-A-C-A-G-C-A-P-G-P-A-P-G-C-A-C-A-P-C-P | 27 | 440 |
| 5169-4_61 | C-G-C3-C-A-G-C-A-P-G-P-A-P-G-C-A-C-A-P-C-P | NB | 441 |
| 5169-4_62 | C-G-A-C3-A-G-C-A-P-G-P-A-P-G-C-A-C-A-P-C-P | 42 | 442 |
| 5169-4_63 | C-G-A-C-C3-G-C-A-P-G-P-A-P-G-C-A-C-A-P-C-P | 29 | 443 |
| 5169-4_64 | C-G-A-C-A-C3-C-A-P-G-P-A-P-G-C-A-C-A-P-C-P | 0.054 | 444 |
| 5169-4_65 | C-G-A-C-A-G-C3-A-P-G-P-A-P-G-C-A-C-A-P-C-P | 0.074 | 445 |
| 5169-4_66 | C-G-A-C-A-G-C-C3-P-G-P-A-P-G-C-A-C-A-P-C-P | 8.5 | 446 |
| 5169-4_67 | C-G-A-C-A-G-C-A-C3-G-P-A-P-G-C-A-C-A-P-C-P | NB | 447 |
| 5169-4_68 | C-G-A-C-A-G-C-A-P-C3-P-A-P-G-C-A-C-A-P-C-P | NB | 448 |
| 5169-4_69 | C-G-A-C-A-G-C-A-P-G-C3-A-P-G-C-A-C-A-P-C-P | NB | 449 |
| 5169-4_70 | C-G-A-C-A-G-C-A-P-G-P-C3-P-G-C-A-C-A-P-C-P | NB | 450 |
| 5169-4_71 | C-G-A-C-A-G-C-A-P-G-P-A-C3-G-C-A-C-A-P-C-P | NB | 451 |
| 5169-4_72 | C-G-A-C-A-G-C-A-P-G-P-A-P-C3-C-A-C-A-P-C-P | 230 | 452 |
| 5169-4_73 | C-G-A-C-A-G-C-A-P-G-P-A-P-G-C3-A-C-A-P-C-P | 0.015 | 453 |
| 5169-4_74 | C-G-A-C-A-G-C-A-P-G-P-A-P-G-C-C3-C-A-P-C-P | 0.37 | 454 |
| 5169-4_75 | C-G-A-C-A-G-C-A-P-G-P-A-P-G-C-A-C3-A-P-C-P | 0.14 | 455 |
| 5169-4_76 | C-G-A-C-A-G-C-A-P-G-P-A-P-G-C-A-C-C3-P-C-P | 1.3 | 456 |

TABLE 7-continued

C3 spacer substitutions at all positions in 5169-4_26.

| Aptamer ID. No. | Sequence (5'→3') | $K_d$ (nM) | Seq. ID. NO. |
|---|---|---|---|
| 5169-4_77 | C-G-A-C-A-G-C-A-P-G-P-A-P-G-C-A-C-A-C3-C-P | NB | 457 |
| 5169-4_78 | C-G-A-C-A-G-C-A-P-G-P-A-P-G-C-A-C-A-P-C3-P | 0.28 | 458 |
| 5169-4_79 | C-G-A-C-A-G-C-A-P-G-P-A-P-G-C-A-C-A-P-C-C3 | NB | 459 |

TABLE 8

2'O-methyl and deoxythymidine substitutions in 5169-4_26.

| Aptamer ID. No. | Sequence (5'→3') | $K_d$ (nM) | Seq. ID. NO. |
|---|---|---|---|
| 5169-4_33 | $C^1$-G-A-C-A-G-C-A-P-G-P-A-P-G-C-A-C-A-P-C-P | 0.027 | 460 |
| 5169-4_34 | C-G-A-$C^1$-A-G-C-A-P-G-P-A-P-G-C-A-C-A-P-C-P | 0.033 | 461 |
| 5169-4_35 | C-G-A-C-A-G-$C^1$-A-P-G-P-A-P-G-C-A-C-A-P-C-P | 0.016 | 462 |
| 5169-4_36 | C-G-A-C-A-G-C-A-P-G-P-A-P-G-$C^1$-A-C-A-P-C-P | 0.028 | 463 |
| 5169-4_37 | C-G-A-C-A-G-C-A-P-G-P-A-P-G-C-A-$C^1$-A-P-C-P | 0.041 | 464 |
| 5169-4_38 | C-G-A-C-A-G-C-A-P-G-P-A-P-G-C-A-C-A-P-$C^1$-P | 0.022 | 465 |
| 5169-4_39 | C-$G^1$-A-C-A-G-C-A-P-G-P-A-P-G-C-A-C-A-P-C-P | 0.058 | 466 |
| 5169-4_40 | C-G-A-C-A-$G^1$-C-A-P-G-P-A-P-G-C-A-C-A-P-C-P | 0.024 | 467 |
| 5169-4_41 | C-G-A-C-A-G-C-A-P-$G^1$-P-A-P-G-C-A-C-A-P-C-P | 0.097 | 468 |
| 5169-4_42 | C-G-A-C-A-G-C-A-P-G-P-A-P-$G^1$-C-A-C-A-P-C-P | 0.0069 | 469 |
| 5169-4_43 | C-G-$A^1$-C-A-G-C-A-P-G-P-A-P-G-C-A-C-A-P-C-P | 0.16 | 470 |
| 5169-4_44 | C-G-A-C-$A^1$-G-C-A-P-G-P-A-P-G-C-A-C-A-P-C-P | 0.53 | 471 |
| 5169-4_45 | C-G-A-C-A-G-C-$A^1$-P-G-P-A-P-G-C-A-C-A-P-C-P | 0.93 | 472 |
| 5169-4_46 | C-G-A-C-A-G-C-A-P-G-P-$A^1$-P-G-C-A-C-A-P-C-P | 0.093 | 473 |
| 5169-4_47 | C-G-A-C-A-G-C-A-P-G-P-A-P-G-C-$A^1$-C-A-P-C-P | 0.016 | 474 |
| 5169-4_48 | C-G-A-C-A-G-C-A-P-G-P-A-P-G-C-A-C-$A^1$-P-C-P | 0.014 | 475 |
| 5169-4_49 | C-G-A-C-A-G-C-A-$P^1$-G-P-A-P-G-C-A-C-A-P-C-P | 0.53 | 476 |

TABLE 8-continued

2'O-methyl and deoxythymidine substitutions in 5169-4_26.

| Aptamer ID. No. | Sequence (5'→3') | $K_d$ (nM) | Seq. ID. NO. |
|---|---|---|---|
| 5169-4_50 | C-G-A-C-A-G-C-A-P-G-P$^1$-A-P-G-C-A-C-A-P-C-P | 0.047 | 477 |
| 5169-4_51 | C-G-A-C-A-G-C-A-P-G-P-A-P$^1$-G-C-A-C-A-P-C-P | 0.32 | 478 |
| 5169-4_52 | C-G-A-C-A-G-C-A-P-G-P-A-P-G-C-A-C-A-P$^1$-C-P | 0.31 | 479 |
| 5169-4_53 | C-G-A-C-A-G-C-A-P-G-P-A-P-G-C-A-C-A-P-C-P$^1$ | 0.022 | 480 |
| 5169-4_54 | C-G-A-C-A-G-C-A-T-G-P-A-P-G-C-A-C-A-P-C-P | 44 | 481 |
| 5169-4_55 | C-G-A-C-A-G-C-A-P-G-T-A-P-G-C-A-C-A-P-C-P | 7.8 | 482 |
| 5169-4_56 | C-G-A-C-A-G-C-A-P-G-P-A-T-G-C-A-C-A-P-C-P | NB | 483 |
| 5169-4_57 | C-G-A-C-A-G-C-A-P-G-P-A-P-G-C-A-C-A-T-C-P | 120 | 484 |
| 5169-4_58 | C-G-A-C-A-G-C-A-P-G-P-A-P-G-C-A-C-A-P-C-T | NB | 485 |

TABLE 9

Multiple 2'-O-methyl substitutions in PDGF aptamer 5169-4_26.

| Aptamer ID. No. | Sequence (5'→3') | $K_d$ (nM) | Seq. ID. NO. |
|---|---|---|---|
| 5169-4_80 | C-G-A-C-A-G-C$^1$-A-P-G-P-A-P-G-C-A$^1$-C-A$^1$-P-C-P | 0.0061 | 486 |
| 5169-4_81 | C-G-A-C-A-G-C$^1$-A-P-G-P-A-P-G$^1$-C-A$^1$-C-A$^1$-P-C-P | 0.0049 | 487 |
| 5169-4_82 | C-G-A-C-A-G$^1$-C$^1$-A-P-G-P-A-P-G$^1$-C-A$^1$-C-A$^1$-P-C$^1$-P | 0.0016 | 488 |
| 5169-4_83 | C$^1$-G-A-C-A-G$^1$-C$^1$-A-P-G-P-A-P-G$^1$-C$^1$-A$^1$-C-A$^1$-P-C$^1$-P$^1$ | 0.0021 | 489 |
| 5169-4_84 | C$^1$-G-A-C$^1$-A-G$^1$-C$^1$-A-P-G-P-A-P-G$^1$-C$^1$-A$^1$-C-A$^1$-P-C$^1$-P$^1$ | 0.0053 | 490 |
| 5169-4_85 | C$^1$-G-A-C$^1$-A-G$^1$-C$^1$-A-P-G-P$^1$-A-P-G$^1$-C$^1$-A$^1$-C$^1$-A$^1$-P-C$^1$-P$^1$ | 0.0062 | 491 |
| 5169-4_86 | C$^1$-G$^1$-A-C$^1$-A-G$^1$-C$^1$-A-P-G-P$^1$-A-P-G$^1$-C$^1$-A$^1$-C$^1$-A$^1$-P-C$^1$-P$^1$ | 0.064 | 492 |
| 5169-4_87 | C$^1$-G$^1$-A-C$^1$-A-G$^1$-C$^1$-A-P-G$^1$-P$^1$-A$^1$-P-G$^1$-C$^1$-A$^1$-C$^1$-A$^1$-P-C$^1$-P$^1$ | NB | 493 |
| 5169-4_88 | C$^1$-G$^1$-A$^1$-C$^1$-A-G$^1$-C$^1$-A-P-G$^1$-P$^1$-A$^1$-P-G$^1$-C$^1$-A$^1$-C$^1$-A$^1$-P-C$^1$-P$^1$ | NB | 494 |
| 5169-4_89 | C$^1$-G$^1$-A$^1$-C$^1$-A-G$^1$-C$^1$-A-P-G$^1$-P$^1$-A$^1$-P$^1$-G$^1$-C$^1$-A$^1$-C$^1$-A$^1$-P-C$^1$-P$^1$ | NB | 495 |
| 5169-4_90 | C$^1$-G$^1$-A$^1$-C$^1$-A$^1$-G$^1$-C$^1$-A-P-G$^1$-P$^1$-A$^1$-P$^1$-G$^1$-C$^1$-A$^1$-C$^1$-A$^1$-P$^1$-C$^1$-P$^1$ | NB | 496 |
| 5169-4_91 | C$^1$-G$^1$-A$^1$-C$^1$-A$^1$-G$^1$-C$^1$-A$^1$-P-G$^1$-P$^1$-A$^1$-P$^1$-G$^1$-C$^1$-A$^1$-C$^1$-A$^1$-P$^1$-C$^1$-P$^1$ | NB | 497 |
| 5169-4_92 | C$^1$-G-A-C-A-G-C$^1$-A-P-G-P-A-P-G-C$^1$-A$^1$-C-A$^1$-P-C$^1$-P$^1$ | 0.0052 | 498 |

TABLE 9-continued

Multiple 2'-O-methyl substitutions in PDGF aptamer 5169-4_26.

| Aptamer ID. No. | Sequence (5'→3') | $K_d$ (nM) | Seq. ID. NO. |
|---|---|---|---|
| 5169-4_105 | C-G-A-C-A-G$^1$-C-A-P-G-P-A-P-G-C-A-C-A$^1$-P-C$^1$-P | 0.0061 | 499 |
| 5169-4_106 | C$^1$-G-A-C-A-G-C-A-P-G-P-A-P-G-C-A-C-A$^1$-P-C$^1$-P | 0.016 | 517 |
| 5169-4_107 | C$^1$-G-A-C-A-G$^1$-C-A-P-G-P-A-P-G-C-A-C-A$^1$-P-C-P | 0.013 | 518 |
| 5169-4_108 | C$^1$-G-A-C-A-G$^1$-C-A-P-G-P-A-P-G$^1$-C-A-C-A-P-C-P | 0.012 | 519 |
| 5169-4_109 | C$^1$-G-A-C-A-G$^1$-C-A-P-G-P-A-P-G-C-A$^1$-C-A-P-C-P | 0.011 | 520 |
| 5169-4_110 | C$^1$-G-A-C-A-G-C-A-P-G-P-A-P-G$^1$-C-A$^1$-C-A-P-C-P | 0.0050 | 521 |
| 5169-4_111 | C-G-A-C-A-G-C$^1$-A-P-G-P-A-P-G$^1$-C-A$^1$-C-A-P-C-P | 0.0048 | 522 |
| 5169-4_112 | C-G-A-C-A-G-C-A-P-G-P-A-P-G$^1$-C-A$^1$-C-A-P-C-P$^1$ | 0.0062 | 523 |
| 5169-4_113 | C-G-A-C-A-G-C$^1$-A-P-G-P-A-P-G-C-A$^1$-C-A-P-C-P$^1$ | 0.012 | 524 |
| 5169-4_114 | C-G-A-C-A-G-C$^1$-A-P-G-P-A-P-G-C-A-C$^1$-A-P-C-P$^1$ | 0.038 | 525 |
| 5169-4_115 | C-G-A-C$^1$-A-G-C$^1$-A-P-G-P-A-P-G-C-A-C-A-P-C-P$^1$ | 0.024 | 526 |
| 5169-4_116 | C-G-A-C$^1$-A-G-C-A-P-G-P-A-P-G-C-A-C$^1$-A-P-C-P$^1$ | 0.093 | 527 |
| 5169-4_117 | C-G-A-C$^1$-A-G-C-A-P-G-P-A$^1$-P-G-C-A-C$^1$-A-P-C-P | 0.71 | 528 |
| 5169-4_118 | C-G$^1$-A-C$^1$-A-G-C-A-P-G-P-A-P-G-C-A-C$^1$-A-P-C-P | 0.56 | 529 |
| 5169-4_119 | C-G$^1$-A-C$^1$-A-G-C-A-P-G-P-A-P-G-C-A-C$^1$-A-P-C-P | NB | 530 |
| 5169-4_120 | C-G$^1$-A-C-A-G-C-A-P-G-P-A$^1$-P-G-C$^1$-A-C-A-P-C-P | NB | 531 |
| 5169-4_121 | C-G$^1$-A-C-A-G-C-A-P-G$^1$-P-A$^1$-P-G-C-A-C-A-P-C-P | NB | 532 |
| 5169-4_122 | C-G$^1$-A-C-A-G-C-A-P-G$^1$-P-A-P-G-C$^1$-A-C-A-P-C-P | NB | 533 |
| 5169-4_123 | C$^1$-G-A-C-A-G-C-A-P-G-P-A-P-G-C-A-C-A-P-C$^1$-P$^1$ | 0.030 | 534 |
| 5169-4_124 | C-G-A-C-A$^1$-G-C-A-P-G-P-A-P-G-C-A-C-A-P-C$^1$-P$^1$ | 0.60 | 535 |
| 5169-4_125 | C$^1$-G-A-C-A$^1$-G-C-A-P-G-P-A-P-G-C-A-C-A-P-C$^1$-P | 1.0 | 536 |
| 5169-4_126 | C-G-A-C-A-G-C-A-P-G-P-A-P-G-C-A-C-A-P$^1$-C$^1$-P$^1$ | NB | 537 |
| 5169-4_127 | C-G-A-C-A-G-C-A-P-G-P-A-P-G-C-A$^1$-C$^1$-A$^1$-P-C-P | 0.010 | 538 |
| 5169-4_128 | C-G-A-C-A-G-C-A-P-G-P-A-P$^1$-G$^1$-C$^1$-A-C-A-P-C-P | 0.099 | 539 |
| 5169-4_129 | C-G-A-C-A-G-C-A-P-G$^1$-P$^1$-A$^1$-P-G-C-A-C-A-P-C-P | NB | 540 |

TABLE 9-continued

Multiple 2'-O-methyl substitutions in PDGF aptamer 5169-4_26.

| Aptamer ID. No. | Sequence (5'→3') | $K_d$ (nM) | Seq. ID. NO. |
|---|---|---|---|
| 5169-4_130 | C-G-A-C-A-G-C¹-A¹-P¹-G-P-A-P-G-C-A-C-A-P-C-P | 4.5 | 541 |
| 5169-4_131 | C-G-A-C¹-A¹-G¹-C-A-P-G-P-A-P-G-C-A-C-A-P-C-P | 0.64 | 542 |
| 5169-4_132 | C¹-G¹-A¹-C-A-G-C-A-P-G-P-A-P-G-C-A-C-A-P-C-P | 0.42 | 543 |
| 5169-4_144 | C¹-G-A-C-A-G-C¹-A-P-G-P-A-P-G¹-C-A¹-C-A¹-P-C-P¹ | 0.00050 | 544 |
| 5169-4_146 | C¹-G-A-C¹-A-G¹-C¹-A-P-G-P-A-P-G¹-C¹-A¹-C¹-A¹-P-C¹-P¹ | 0.00060 | 545 |

TABLE 10

Truncations of VEGF aptamer Clone 4867-31.

| Aptamer ID. No. | length | Sequence (5'→3') | $K_d$ (nM) hVEGF165 | $K_d$ (nM) rVEGF164 | $K_d$ (nM) hVEGF121 | Seq. ID. NO. |
|---|---|---|---|---|---|---|
| OH-4867-31_22 | 38 | T-C-A-A-P-C-A-G-C-C-G-P-P-C-A-A-G-P-G-C-P-P-G-P-A-G-G-A-P-P-P-A-A-A-P-G-G-A | 0.26 | 0.54 | 0.82 | 546 |
| OH-4867-31_23 | 37 | T-C-A-A-P-C-A-G-C-C-G-P-P-C-A-A-G-P-G-C-P-P-G-P-A-G-G-A-P-P-P-A-A-A-P-G-G | 0.30 | 0.66 | 1.3 | 547 |
| OH-4867-31_24 | 36 | T-C-A-A-P-C-A-G-C-C-G-P-P-C-A-A-G-P-G-C-P-P-G-P-A-G-G-A-P-P-P-A-A-A-P-G | 2.8 | 4.2 | 36 | 548 |
| OH-4867-31_25 | 35 | T-C-A-A-P-C-A-G-C-C-G-P-P-C-A-A-G-P-G-C-P-P-G-P-A-G-G-A-P-P-P-A-A-A-P | 26 | 16 | 70 | 549 |
| OH-4867-31-26 | 39 | C-A-A-P-C-A-G-C-C-G-P-P-C-A-A-G-P-G-C-P-P-G-P-A-G-G-A-P-P-P-A-A-A-P-G-G-A-A-P | 0.075 | 0.07 | 0.49 | 550 |
| OH-4867-31-27 | 38 | A-A-P-C-A-G-C-C-G-P-P-C-A-A-G-P-G-C-P-P-G-P-A-G-G-A-P-P-P-A-A-A-P-G-G-A-A-P | 0.11 | 0.07 | 0.59 | 551 |
| OH-4867-31-28 | 37 | A-P-C-A-G-C-C-G-P-P-C-A-A-G-P-G-C-P-P-G-P-A-G-G-A-P-P-P-A-A-A-P-G-G-A-A-P | 0.10 | 0.07 | 0.97 | 552 |
| OH-4867-31-29 | 36 | P-C-A-G-C-C-G-P-P-C-A-A-G-P-G-C-P-P-G-P-A-G-G-A-P-P-P-A-A-A-P-G-G-A-A-P | 0.13 | 0.08 | 0.96 | 553 |
| OH-4867-31-30 | 35 | C-A-G-C-C-G-P-P-C-A-A-G-P-G-C-P-P-G-P-A-G-G-A-P-P-P-A-A-A-P-G-G-A-A-P | 0.20 | 0.15 | 1.4 | 554 |
| OH-4867-31-31 | 34 | A-G-C-C-G-P-P-C-A-A-G-P-G-C-P-P-G-P-A-G-G-A-P-P-P-A-A-A-P-G-G-A-A-P | 0.17 | 0.12 | 1.0 | 555 |
| OH-4867-31-32 | 38 | C-A-A-P-C-A-G-C-C-G-P-P-C-A-G-P-G-C-P-P-G-P-A-G-G-A-P-P-P-A-A-A-P-G-G-A-A | 0.10 | 0.06 | 0.51 | 556 |
| OH-4867-31-33 | 37 | A-A-P-C-A-G-C-C-G-P-P-C-A-A-G-P-G-C-P-P-G-P-A-G-G-A-P-P-P-A-A-A-P-G-G-A-A | 0.11 | 0.04 | 0.55 | 557 |

TABLE 10-continued

Truncations of VEGF aptamer Clone 4867-31.

| Aptamer ID. No. | length | Sequence (5'→ 3') | $K_d$ (nM) hVEGF165 | $K_d$ (nM) rVEGF164 | $K_d$ (nM) hVEGF121 | Seq. ID. NO. |
|---|---|---|---|---|---|---|
| OH-4867-31-34 | 36 | A-P-C-A-G-C-C-G-P-P-C-A-A-G-P-G-C-P-P-G-P-A-G-G-A-P-P-P-A-A-A-P-G-G-A-A | 0.35 | 0.05 | 0.47 | 558 |
| OH-4867-31-35 | 35 | P-C-A-G-C-C-G-P-P-C-A-A-G-P-G-C-P-P-G-P-A-G-G-A-P-P-P-A-A-P-G-G-A-A | 0.11 | 0.05 | flat | 559 |
| OH-4867-31-36 | 34 | C-A-G-C-C-G-P-P-C-A-A-G-P-G-C-P-P-G-P-A-G-G-A-P-P-P-A-A-A-P-G-G-A-A | 0.11 | 0.06 | 0.39 | 560 |
| OH-4867-31-37 | 33 | A-G-C-C-G-P-P-C-A-A-G-P-G-C-P-P-G-P-A-G-G-A-P-P-P-A-A-A-P-G-G-A-A | 0.092 | 0.04 | 0.21 | 561 |
| OH-4867-31-38 | 37 | C-A-A-P-C-A-G-C-C-G-P-P-C-A-G-P-G-C-P-P-G-P-A-G-G-A-P-P-P-A-A-A-P-G-G-A | 0.17 | 0.09 | 0.81 | 562 |
| OH-4867-31-39 | 36 | A-A-P-C-A-G-C-C-G-P-P-C-A-G-P-G-C-P-P-G-P-A-G-G-A-P-P-P-A-A-A-P-G-G-A | 0.20 | 0.09 | 0.62 | 563 |
| OH-4867-31-40 | 35 | A-P-C-A-G-C-C-G-P-P-C-A-A-G-P-G-C-P-P-G-P-A-G-G-A-P-P-P-A-A-A-P-G-G-A | 0.14 | 0.10 | 0.70 | 564 |
| OH-4867-31-41 | 34 | P-C-A-G-C-C-G-P-P-C-A-A-G-P-G-C-P-P-G-P-A-G-G-A-P-P-P-A-A-A-P-G-G-A | 0.13 | 0.08 | 0.63 | 565 |
| OH-4867-31-42 | 33 | C-A-G-C-C-G-P-P-C-A-A-G-P-G-C-P-P-G-P-A-G-G-A-P-P-P-A-A-A-P-G-G-A | 0.071 | 0.05 | 0.20 | 566 |
| OH-4867-31-43 | 32 | A-G-C-C-G-P-P-C-A-A-G-P-G-C-P-P-G-P-A-G-G-A-P-P-P-A-A-A-P-G-G-A | 0.050 | 0.05 | 0.29 | 567 |
| OH-4867-31-44 | 32 | C-A-G-C-C-G-P-P-C-A-A-G-P-G-C-P-P-G-P-A-G-G-A-P-P-P-A-A-A-P-G-G | 0.13 | 0.38 | 0.14 | 568 |
| OH-4867-31-45 | 31 | C-A-G-C-C-G-P-P-C-A-A-G-P-G-C-P-P-G-P-A-G-G-A-P-P-P-A-A-A-P-G | 1.1 | 4.5 | 3.3 | 569 |
| OH-4867-31-46 | 30 | C-A-G-C-C-G-P-P-C-A-A-G-P-G-C-P-P-G-P-A-G-G-A-P-P-P-A-A-A-P | 5.9 | 9.6 | NB | 570 |
| OH-4867-31-47 | 29 | C-A-G-C-C-G-P-P-C-A-A-G-P-G-C-P-P-G-P-A-G-G-A-P-P-P-A-A-A | NB | 83 | NB | 571 |
| OH-4867-31-48 | 28 | C-A-G-C-C-G-P-P-C-A-A-G-P-G-C-P-P-G-P-A-G-G-A-P-P-P-A-A | NB | 142 | NB | 572 |
| OH-4867-31-49 | 27 | C-A-G-C-C-G-P-P-C-A-A-G-P-G-C-P-P-G-P-A-G-G-A-P-P-P-A | NB | NB | NB | 573 |
| OH-4867-31-50 | 26 | C-A-G-C-C-G-P-P-C-A-A-G-P-G-C-P-P-G-P-A-G-G-A-P-P-P | NB | NB | NB | 574 |
| OH-4867-31-51 | 31 | A-G-C-C-G-P-P-C-A-A-G-P-G-C-P-P-G-P-A-G-G-A-P-P-P-A-A-A-P-G-G | 0.11 | 0.074 | 0.20 | 575 |
| OH-4867-31-52 | 30 | A-G-C-C-G-P-P-C-A-A-G-P-G-C-P-P-G-P-A-G-G-A-P-P-P-A-A-A-P-G | 0.17 | 0.58 | 2.8 | 576 |

TABLE 10-continued

Truncations of VEGF aptamer Clone 4867-31.

| Aptamer ID. No. | length | Sequence (5'→ 3') | K_d (nM) hVEGF165 | K_d (nM) rVEGF164 | K_d (nM) hVEGF121 | Seq. ID. NO. |
|---|---|---|---|---|---|---|
| OH-4867-31-53 | 29 | A-G-C-C-G-P-P-C-A-A-G-P-G-C-P-P-G-P-A-G-G-A-P-P-P-A-A-A-P | 3.2 | NB | 19 | 577 |
| OH-4867-31-54 | 28 | A-G-C-C-G-P-P-C-A-A-G-P-G-C-P-P-G-P-A-G-G-A-P-P-P-A-A-A | NB | NB | NB | 578 |
| OH-4867-31-55 | 27 | A-G-C-C-G-P-P-C-A-A-G-P-G-C-P-P-G-P-A-G-G-A-P-P-P-A-A | NB | NB | NB | 579 |
| OH-4867-31-56 | 26 | A-G-C-C-G-P-P-C-A-A-G-P-G-C-P-P-G-P-A-G-G-A-P-P-P-A | NB | NB | NB | 580 |
| OH-4867-31-57 | 25 | A-G-C-C-G-P-P-C-A-A-G-P-G-C-P-P-G-P-A-G-G-A-P-P-P | NB | NB | NB | 581 |
| OH-4867-31-58 | 31 | G-C-C-G-P-P-C-A-A-G-P-G-C-P-P-G-P-A-G-G-A-P-P-P-A-A-A-P-G-G-A | 0.10 | 0.21 | 0.15 | 582 |
| OH-4867-31-59 | 30 | C-C-G-P-P-C-A-A-G-P-G-C-P-P-G-P-A-G-G-A-P-P-P-A-A-A-P-G-G-A | 0.16 | 0.20 | 0.14 | 583 |
| OH-4867-31-60 | 29 | C-G-P-P-C-A-A-G-P-G-C-P-P-G-P-A-G-G-A-P-P-P-A-A-A-P-G-G-A | 0.61 | 1.4 | 2.2 | 584 |
| OH-4867-31-61 | 28 | G-P-P-C-A-A-G-P-G-C-P-P-G-P-A-G-G-A-P-P-P-A-A-A-P-G-G-A | 2.9 | 13 | 33 | 585 |
| OH-4867-31_143 | 29 | C-C-G-P-P-C-A-A-G-P-G-C-P-P-G-P-A-G-G-A-P-P-P-A-A-A-P-G-G | | | 0.17 | 586 |
| OH-4867-31_144 | 30 | G-C-C-G-P-P-C-A-A-G-P-G-C-P-P-G-P-A-G-G-A-P-P-P-A-A-A-P-G-G | | | 0.20 | 587 |

TABLE 11

C3 spacer substitutions at all positions in 4867-15_2.

| Aptamer ID. No. | Sequence 5'→ 3' | K_d (nM) | ratio to parent | Seq. ID. NO. |
|---|---|---|---|---|
| OH-4867-31_2 | C-C-C-T-C-C-A-P-C-A-G-C-C-G-P-P-C-A-A-G-P-G-C-P-P-G-P-A-G-G-A-P-P-P-A-A-A-P-G-G-A-A-P-P-G-G-A-G-G-A | 0.15 | 1 | 588 |
| OH-4867-15-24 | V-C-C-T-C-C-A-P-C-A-G-C-C-G-P-P-C-A-A-G-P-G-C-P-P-G-P-A-G-G-A-P-P-P-A-A-A-P-G-G-A-A-P-P-G-G-A-G-G-A | 0.11 | 0.72 | 589 |
| OH-4867-15-25 | C-V-C-T-C-C-A-P-C-A-G-C-C-G-P-P-C-A-A-G-P-G-C-P-P-G-P-A-G-G-A-P-P-P-A-A-A-P-G-G-A-A-P-P-G-G-A-G-G-A | 0.13 | 0.84 | 590 |
| OH-4867-15-26 | C-C-V-T-C-C-A-P-C-A-G-C-C-G-P-P-C-A-A-G-P-G-C-P-P-G-P-A-G-G-A-P-P-P-A-A-A-P-G-G-A-A-P-P-G-G-A-G-G-A | 0.20 | 1.3 | 591 |
| OH-4867-15-27 | C-C-C-V-C-C-A-P-C-A-G-C-C-G-P-P-C-A-A-G-P-G-C-P-P-G-P-A-G-G-A-P-P-P-A-A-A-P-G-G-A-A-P-P-G-G-A-G-G-A | 0.40 | 2.7 | 592 |
| OH-4867-15-28 | C-C-C-T-V-C-A-P-C-A-G-C-C-G-P-P-C-A-A-G-P-G-C-P-P-G-P-A-G-G-A-P-P-P-A-A-A-P-G-G-A-A-P-P-G-G-A-G-G-A | 0.34 | 2.3 | 593 |
| OH-4867-15-29 | C-C-C-T-C-V-A-P-C-A-G-C-C-G-P-P-C-A-A-G-P-G-C-P-P-G-P-A-G-G-A-P-P-P-A-A-A-P-G-G-A-A-P-P-G-G-A-G-G-A | 0.20 | 1.4 | 594 |
| OH-4867-15-30 | C-C-C-T-C-C-V-P-C-A-G-C-C-G-P-P-C-A-A-G-P-G-C-P-P-G-P-A-G-G-A-P-P-P-A-A-A-P-G-G-A-A-P-P-G-G-A-G-G-A | 0.11 | 0.76 | 595 |
| OH-4867-15-31 | C-C-C-T-C-C-A-V-C-A-G-C-C-G-P-P-C-A-A-G-P-G-C-P-P-G-P-A-G-G-A-P-P-P-A-A-A-P-G-G-A-A-P-P-G-G-A-G-G-A | 0.095 | 0.64 | 596 |

TABLE 11-continued

C3 spacer substitutions at all positions in 4867-15_2.

| Aptamer ID. No. | Sequence 5'→ 3' | K$_d$ (nM) | ratio to parent | Seq. ID. NO. |
|---|---|---|---|---|
| OH-4867-15-32 | C-C-C-T-C-C-A-P-V-A-G-C-C-G-P-P-C-A-A-G-P-G-C-P-P-G-P-A-G-G-A-P-P-P-A-A-A-P-G-G-A-A-P-P-G-G-A-G-G-A | 0.079 | 0.53 | 597 |
| OH-4867-15-33 | C-C-C-T-C-C-A-P-C-V-G-C-C-G-P-P-C-A-A-G-P-G-C-P-P-G-P-A-G-G-A-P-P-P-A-A-A-P-G-G-A-A-P-P-G-G-A-G-G-A | 0.12 | 0.83 | 598 |
| OH-4867-15-34 | C-C-C-T-C-C-A-P-C-A-V-C-C-G-P-P-C-A-A-G-P-G-C-P-P-G-P-A-G-G-A-P-P-P-A-A-A-P-G-G-A-A-P-P-G-G-A-G-G-A | 0.14 | 0.95 | 599 |
| OH-4867-15-35 | C-C-C-T-C-C-A-P-C-A-G-V-C-G-P-P-C-A-A-G-P-G-C-P-P-G-P-A-G-G-A-P-P-P-A-A-A-P-G-G-A-A-P-P-G-G-A-G-G-A | 3.4 | 23 | 600 |
| OH-4867-15-36 | C-C-C-T-C-C-A-P-C-A-G-C-V-G-P-P-C-A-A-G-P-G-C-P-P-G-P-A-G-G-A-P-P-P-A-A-A-P-G-G-A-A-P-P-G-G-A-G-G-A | 23 | 153 | 601 |
| OH-4867-15-37 | C-C-C-T-C-C-A-P-C-A-G-C-C-V-P-P-C-A-A-G-P-G-C-P-P-G-P-A-G-G-A-P-P-P-A-A-A-P-G-G-A-A-P-P-G-G-A-G-G-A | 30 | 205 | 602 |
| OH-4867-15-38 | C-C-C-T-C-C-A-P-C-A-G-C-C-G-V-P-C-A-A-G-P-G-C-P-P-G-P-A-G-G-A-P-P-P-A-A-A-P-G-G-A-A-P-P-G-G-A-G-G-A | NB | — | 603 |
| OH-4867-15-39 | C-C-C-T-C-C-A-P-C-A-G-C-C-G-P-V-C-A-A-G-P-G-C-P-P-G-P-A-G-G-A-P-P-P-A-A-A-P-G-G-A-A-P-P-G-G-A-G-G-A | NB | — | 604 |
| OH-4867-15-40 | C-C-C-T-C-C-A-P-C-A-G-C-C-G-P-P-V-A-A-G-P-G-C-P-P-G-P-A-G-G-A-P-P-P-A-A-A-P-G-G-A-A-P-P-G-G-A-G-G-A | 0.17 | 1.1 | 605 |
| OH-4867-15-41 | C-C-C-T-C-C-A-P-C-A-G-C-C-G-P-P-C-V-A-G-P-G-C-P-P-G-P-A-G-G-A-P-P-P-A-A-A-P-G-G-A-A-P-P-G-G-A-G-G-A | 13 | 85 | 606 |
| OH-4867-15-42 | C-C-C-T-C-C-A-P-C-A-G-C-C-G-P-P-C-A-V-G-P-G-C-P-P-G-P-A-G-G-A-P-P-P-A-A-A-P-G-G-A-A-P-P-G-G-A-G-G-A | 31 | 207 | 607 |
| OH-4867-15-43 | C-C-C-T-C-C-A-P-C-A-G-C-C-G-P-P-C-A-A-V-P-G-C-P-P-G-P-A-G-G-A-P-P-P-A-A-A-P-G-G-A-A-P-P-G-G-A-G-G-A | 9.2 | 62 | 608 |
| OH-4867-15-44 | C-C-C-T-C-C-A-P-C-A-G-C-C-G-P-P-C-A-A-G-V-G-C-P-P-G-P-A-G-G-A-P-P-P-A-A-A-P-G-G-A-A-P-P-G-G-A-G-G-A | NB | — | 609 |
| OH-4867-15-45 | C-C-C-T-C-C-A-P-C-A-G-C-C-G-P-P-C-A-A-G-P-V-C-P-P-G-P-A-G-G-A-P-P-P-A-A-A-P-G-G-A-A-P-P-G-G-A-G-G-A | 3.5 | 24 | 610 |
| OH-4867-15-46 | C-C-C-T-C-C-A-P-C-A-G-C-C-G-P-P-C-A-A-G-P-G-V-P-P-G-P-A-G-G-A-P-P-P-A-A-A-P-G-G-A-A-P-P-G-G-A-G-G-A | NB | — | 611 |
| OH-4867-15-47 | C-C-C-T-C-C-A-P-C-A-G-C-C-G-P-P-C-A-A-G-P-G-C-V-P-G-P-A-G-G-A-P-P-P-A-A-A-P-G-G-A-A-P-P-G-G-A-G-G-A | NB | — | 612 |
| OH-4867-15-48 | C-C-C-T-C-C-A-P-C-A-G-C-C-G-P-P-C-A-A-G-P-G-C-P-V-G-P-A-G-G-A-P-P-P-A-A-A-P-G-G-A-A-P-P-G-G-A-G-G-A | NB | — | 613 |
| OH-4867-15-49 | C-C-C-T-C-C-A-P-C-A-G-C-C-G-P-P-C-A-A-G-P-G-C-P-P-V-P-A-G-G-A-P-P-P-A-A-A-P-G-G-A-A-P-P-G-G-A-G-G-A | 0.079 | 0.54 | 614 |
| OH-4867-15-50 | C-C-C-T-C-C-A-P-C-A-G-C-C-G-P-P-C-A-A-G-P-G-C-P-P-G-V-A-G-G-A-P-P-P-A-A-A-P-G-G-A-A-P-P-G-G-A-G-G-A | 3.5 | 24 | 615 |
| OH-4867-15-51 | C-C-C-T-C-C-A-P-C-A-G-C-C-G-P-P-C-A-A-G-P-G-C-P-P-G-P-V-G-G-A-P-P-P-A-A-A-P-G-G-A-A-P-P-G-G-A-G-G-A | 1.6 | 11 | 616 |
| OH-4867-15-52 | C-C-C-T-C-C-A-P-C-A-G-C-C-G-P-P-C-A-A-G-P-G-C-P-P-G-P-A-V-G-A-P-P-P-A-A-A-P-G-G-A-A-P-P-G-G-A-G-G-A | 0.20 | 1.3 | 617 |
| OH-4867-15-53 | C-C-C-T-C-C-A-P-C-A-G-C-C-G-P-P-C-A-A-G-P-G-C-P-P-G-P-A-G-G-A-V-A-P-P-P-A-A-A-P-G-G-A-A-P-P-G-G-A-G-G-A | 23 | 157 | 618 |
| OH-4867-15-54 | C-C-C-T-C-C-A-P-C-A-G-C-C-G-P-P-C-A-A-G-P-G-C-P-P-G-P-A-G-G-A-G-V-P-P-P-A-A-A-P-G-G-A-A-P-P-G-G-A-G-G-A | NB | — | 619 |
| OH-4867-15-55 | C-C-C-T-C-C-A-P-C-A-G-C-C-G-P-P-C-A-A-G-P-G-C-P-P-G-P-A-G-G-A-G-A-V-P-P-A-A-A-P-G-G-A-A-P-P-G-G-A-G-G-A | NB | — | 620 |
| OH-4867-15-56 | C-C-C-T-C-C-A-P-C-A-G-C-C-G-P-P-C-A-A-G-P-G-C-P-P-G-P-A-G-G-A-G-A-P-V-P-A-A-A-P-G-G-A-A-P-P-G-G-A-G-G-A | NB | — | 621 |

TABLE 11-continued

C3 spacer substitutions at all positions in 4867-15_2.

| Aptamer ID. No. | Sequence 5'→ 3' | K$_d$ (nM) | ratio to parent | Seq. ID. NO. |
|---|---|---|---|---|
| OH-4867-15-57 | C-C-C-T-C-C-A-P-C-A-G-C-C-G-P-P-C-A-A-G-P-G-C-P-P-G-P-A-G-G-A-P-P-V-A-A-P-G-G-A-A-P-P-G-G-A-G-G-A | NB | — | 622 |
| OH-4867-15-58 | C-C-C-T-C-C-A-P-C-A-G-C-C-G-P-P-C-A-A-G-P-G-C-P-P-G-P-A-G-G-A-P-P-P-V-A-A-P-G-G-A-A-P-P-G-G-A-G-G-A | NB | — | 623 |
| OH-4867-15-59 | C-C-C-T-C-C-A-P-C-A-G-C-C-G-P-P-C-A-A-G-P-G-C-P-P-G-P-A-G-G-A-P-P-P-A-V-A-P-G-G-A-A-P-P-G-G-A-G-G-A | NB | — | 624 |
| OH-4867-15-60 | C-C-C-T-C-C-A-P-C-A-G-C-C-G-P-P-C-A-A-G-P-G-C-P-P-G-P-A-G-G-A-P-P-P-A-A-V-P-G-G-A-A-P-P-G-G-A-G-G-A | NB | — | 625 |
| OH-4867-15-61 | C-C-C-T-C-C-A-P-C-A-G-C-C-G-P-P-C-A-A-G-P-G-C-P-P-G-P-A-G-G-A-P-P-P-A-A-A-V-G-G-A-A-P-P-G-G-A-G-G-A | NB | — | 626 |
| OH-4867-15-62 | C-C-C-T-C-C-A-P-C-A-G-C-C-G-P-P-C-A-A-G-P-G-C-P-P-G-P-A-G-G-A-P-P-P-A-A-A-P-V-G-A-A-P-P-G-G-A-G-G-A | 53 | 361 | 627 |
| OH-4867-15-63 | C-C-C-T-C-C-A-P-C-A-G-C-C-G-P-P-C-A-A-G-P-G-C-P-P-G-P-A-G-G-A-P-P-P-A-A-A-P-G-V-A-A-P-P-G-G-A-G-G-A | 15 | 101 | 628 |
| OH-4867-15-64 | C-C-C-T-C-C-A-P-C-A-G-C-C-G-P-P-C-A-A-G-P-G-C-P-P-G-P-A-G-G-A-P-P-P-A-A-A-P-G-G-V-A-P-P-G-G-A-G-G-A | 0.22 | 1.5 | 629 |
| OH-4867-15-65 | C-C-C-T-C-C-A-P-C-A-G-C-C-G-P-P-C-A-A-G-P-G-C-P-P-G-P-A-G-G-A-P-P-P-A-A-A-P-G-G-A-V-P-P-G-G-A-G-G-A | 0.13 | 0.88 | 630 |
| OH-4867-15-66 | C-C-C-T-C-C-A-P-C-A-G-C-C-G-P-P-C-A-A-G-P-G-C-P-P-G-P-A-G-G-A-P-P-P-A-A-A-P-G-G-A-A-V-P-G-G-A-G-G-A | 0.11 | 0.72 | 631 |
| OH-4867-15-67 | C-C-C-T-C-C-A-P-C-A-G-C-C-G-P-P-C-A-A-G-P-G-C-P-P-G-P-A-G-G-A-P-P-P-A-A-A-P-G-G-A-A-P-V-G-G-A-G-G-A | 0.15 | 0.99 | 632 |
| OH-4867-15-68 | C-C-C-T-C-C-A-P-C-A-G-C-C-G-P-P-C-A-A-G-P-G-C-P-P-G-P-A-G-G-A-P-P-P-A-A-A-P-G-G-A-A-P-P-V-G-A-G-G-A | 0.32 | 2.1 | 633 |
| OH-4867-15-69 | C-C-C-T-C-C-A-P-C-A-G-C-C-G-P-P-C-A-A-G-P-G-C-P-P-G-P-A-G-G-A-P-P-P-A-A-A-P-G-G-A-A-P-P-G-V-A-G-G-A | 0.77 | 5.2 | 634 |
| OH-4867-15-70 | C-C-C-T-C-C-A-P-C-A-G-C-C-G-P-P-C-A-A-G-P-G-C-P-P-G-P-A-G-G-A-P-P-P-A-A-A-P-G-G-A-A-P-P-G-G-V-G-G-A | 0.68 | 4.6 | 635 |
| OH-4867-15-71 | C-C-C-T-C-C-A-P-C-A-G-C-C-G-P-P-C-A-A-G-P-G-C-P-P-G-P-A-G-G-A-P-P-P-A-A-A-P-G-G-A-A-P-P-G-G-A-V-G-A | 0.24 | 1.6 | 636 |
| OH-4867-15-72 | C-C-C-T-C-C-A-P-C-A-G-C-C-G-P-P-C-A-A-G-P-G-C-P-P-G-P-A-G-G-A-P-P-P-A-A-A-P-G-G-A-A-P-P-G-G-A-G-V-A | 0.19 | 1.3 | 637 |
| OH-4867-15-73 | C-C-C-T-C-C-A-P-C-A-G-C-C-G-P-P-C-A-A-G-P-G-C-P-P-G-P-A-G-G-A-P-P-P-A-A-A-P-G-G-A-A-P-P-G-G-A-G-G-V | 0.17 | 1.1 | 638 |

TABLE 12

2'-O-methyl substitutions in VEGF aptamer 4867-31_43

| Aptamer ID. No. | Sequence 5' → 3' | K$_d$ (nM) | ratio to parent | Seq. ID. NO. |
|---|---|---|---|---|
| OH-4867-31-43 | A-G-C-C-G-P-P-C-A-A-G-P-G-C-P-P-G-P-A-G-G-A-P-P-P-A-A-A-P-G-G-A | 0.29 | 1.0 | 567 |
| OH-4867-31_65 | A$^1$-G-C-C-G-P-P-C-A-A-G-P-G-C-P-P-G-P-A-G-G-A-P-P-P-A-A-A-P-G-G-A | NB | — | 639 |
| OH-4867-31_66 | A-G$^1$-C-C-G-P-P-C-A-A-G-P-G-C-P-P-G-P-A-G-G-A-P-P-P-A-A-A-P-G-G-A | 0.17 | 0.6 | 640 |
| OH-4867-31_67 | A-G-C$^1$-C-G-P-P-C-A-A-G-P-G-C-P-P-G-P-A-G-G-A-P-P-P-A-A-A-P-G-G-A | 0.33 | 1.2 | 641 |

TABLE 12-continued

2'-O-methyl substitutions in VEGF aptamer 4867-31_43

| Aptamer ID. No. | Sequence 5' → 3' | $K_d$ (nM) | ratio to parent | Seq. ID. NO. |
|---|---|---|---|---|
| OH-4867-31_68 | A-G-C-C¹-G-P-P-C-A-A-G-P-G-C-P-P-G-P-A-G-G-A-P-P-P-A-A-A-P-G-G-A | 7.55 | 26.0 | 642 |
| OH-4867-31_69 | A-G-C-C-G¹-P-P-C-A-A-G-P-G-C-P-P-G-P-A-G-G-A-P-P-P-A-A-A-P-G-G-A | NB | — | 643 |
| OH-4867-31_70 | A-G-C-C-G-U¹-P-C-A-A-G-P-G-C-P-P-G-P-A-G-G-A-P-P-P-A-A-A-P-G-G-A | NB | — | 644 |
| OH-4867-31_71 | A-G-C-C-G-P-U¹-C-A-A-G-P-G-C-P-P-G-P-A-G-G-A-P-P-P-A-A-A-P-G-G-A | NB | — | 645 |
| OH-4867-31_72 | A-G-C-C-G-P-P-C¹-A-A-G-P-G-C-P-P-G-P-A-G-G-A-P-P-P-A-A-A-P-G-G-A | 0.21 | 0.7 | 646 |
| OH-4867-31_73 | A-G-C-C-G-P-P-C-A¹-A-G-P-G-C-P-P-G-P-A-G-G-A-P-P-P-A-A-A-P-G-G-A | 5.99 | 20.7 | 647 |
| OH-4867-31_74 | A-G-C-C-G-P-P-C-A-A¹-G-P-G-C-P-P-G-P-A-G-G-A-P-P-P-A-A-A-P-G-G-A | 3.14 | 10.8 | 648 |
| OH-4867-31_75 | A-G-C-C-G-P-P-C-A-A-G¹-P-G-C-P-P-G-P-A-G-G-A-P-P-P-A-A-A-P-G-G-A | 0.15 | 0.5 | 649 |
| OH-4867-31_76 | A-G-C-C-G-P-P-C-A-A-G-U¹-G-C-P-P-G-P-A-G-G-A-P-P-P-A-A-A-P-G-G-A | 22.90 | 79.0 | 650 |
| OH-4867-31_77 | A-G-C-C-G-P-P-C-A-A-G-P-G¹-C-P-P-G-P-A-G-G-A-P-P-P-A-A-A-P-G-G-A | 6.64 | 22.9 | 651 |
| OH-4867-31_78 | A-G-C-C-G-P-P-C-A-A-G-P-G-C¹-P-P-G-P-A-G-G-A-P-P-P-A-A-A-P-G-G-A | 0.24 | 0.8 | 652 |
| OH-4867-31_79 | A-G-C-C-G-P-P-C-A-A-G-P-G-C-U¹-P-G-P-A-G-G-A-P-P-P-A-A-A-P-G-G-A | NB | — | 653 |
| OH-4867-31_80 | A-G-C-C-G-P-P-C-A-A-G-P-G-C-P-U¹-G-P-A-G-G-A-P-P-P-A-A-A-P-G-G-A | NB | — | 654 |
| OH-4867-31_81 | A-G-C-C-G-P-P-C-A-A-G-P-G-C-P-P-G¹-P-A-G-G-A-P-P-P-A-A-A-P-G-G-A | 0.44 | 1.5 | 655 |
| OH-4867-31_82 | A-G-C-C-G-P-P-C-A-A-G-P-G-C-P-P-G-U¹-A-G-G-A-P-P-P-A-A-A-P-G-G-A | NB | — | 656 |
| OH-4867-31_83 | A-G-C-C-G-P-P-C-A-A-G-P-G-C-P-P-G-P-A¹-G-G-A-P-P-P-A-A-A-P-G-G-A | 0.10 | 0.3 | 657 |
| OH-4867-31_84 | A-G-C-C-G-P-P-C-A-A-G-P-G-C-P-P-G-P-A-G¹-G-A-P-P-P-A-A-A-P-G-G-A | 0.21 | 0.7 | 658 |
| OH-4867-31_85 | A-G-C-C-G-P-P-C-A-A-G-P-G-C-P-P-G-P-A-G-G¹-A-P-P-P-A-A-A-P-G-G-A | 25.80 | 89.0 | 659 |
| OH-4867-31_86 | A-G-C-C-G-P-P-C-A-A-G-P-G-C-P-P-G-P-A-G-G-A¹-P-P-P-A-A-A-P-G-G-A | 6.21 | 21.4 | 660 |
| OH-4867-31_87 | A-G-C-C-G-P-P-C-A-A-G-P-G-C-P-P-G-P-A-G-G-A-U¹-P-P-A-A-A-P-G-G-A | NB | — | 661 |
| OH-4867-31_88 | A-G-C-C-G-P-P-C-A-A-G-P-G-C-P-P-G-P-A-G-G-A-P-U¹-P-A-A-A-P-G-G-A | NB | — | 662 |
| OH-4867-31_89 | A-G-C-C-G-P-P-C-A-A-G-P-G-C-P-P-G-P-A-G-G-A-P-P-U¹-A-A-A-P-G-G-A | NB | — | 663 |
| OH-4867-31_90 | A-G-C-C-G-P-P-C-A-A-G-P-G-C-P-P-G-P-A-G-G-A-P-P-P-A¹-A-A-P-G-G-A | 2.85 | 9.8 | 664 |
| OH-4867-31_91 | A-G-C-C-G-P-P-C-A-A-G-P-G-C-P-P-G-P-A-G-G-A-P-P-P-A-A¹-A-P-G-G-A | 0.35 | 1.2 | 665 |
| OH-4867-31_92 | A-G-C-C-G-P-P-C-A-A-G-P-G-C-P-P-G-P-A-G-G-A-P-P-P-A-A-A¹-P-G-G-A | 8.87 | 30.6 | 666 |

TABLE 12-continued

2'-O-methyl substitutions in VEGF aptamer 4867-31_43

| Aptamer ID. No. | Sequence 5' → 3' | $K_d$ (nM) | ratio to parent | Seq. ID. NO. |
|---|---|---|---|---|
| OH-4867-31_93 | A-G-C-C-G-P-P-C-A-A-G-P-G-C-P-P-G-P-A-G-G-A-P-P-P-A-A-A-U$^l$-G-G-A | NB | — | 667 |
| OH-4867-31_94 | A-G-C-C-G-P-P-C-A-A-G-P-G-C-P-P-G-P-A-G-G-A-P-P-P-A-A-A-P-G$^l$-G-A | 0.21 | 0.7 | 668 |
| OH-4867-31_95 | A-G-C-C-G-P-P-C-A-A-G-P-G-C-P-P-G-P-A-G-G-A-P-P-P-A-A-A-P-G-G$^l$-A | 0.19 | 0.7 | 669 |
| OH-4867-31_96 | A-G-C-C-G-P-P-C-A-A-G-P-G-C-P-P-G-P-A-G-G-A-P-P-P-A-A-A-P-G-G-A$^l$ | 0.13 | 0.4 | 670 |
| OH-4867-31_97 | A-G-C-C-G-P-P-V-A-A-G-P-G-C-P-P-G-P-A-G-G-A-P-P-P-A-A-A-P-G-G-A | 7.30 | 25.2 | 671 |
| OH-4867-31_98 | A-G-C-C-G-P-P-C-A-A-G-P-G-C-P-P-V-P-A-G-G-A-P-P-P-A-A-A-P-G-G-A | 0.10 | 0.3 | 672 |
| OH-4867-31_99 | A-G-C-C-G-P-P-C-A-A-G-P-G-C-P-P-G-P-A-V-G-A-P-P-P-A-A-A-P-G-G-A | 0.22 | 0.8 | 673 |
| OH-4867-31_100 | A-G-C-C-G-P-P-V-A-A-G-P-G-C-P-P-V-P-A-V-G-A-P-P-P-A-A-A-P-G-G-A | NB | — | 674 |
| OH-4867-31_101 | A-G-C-C-G-P-P-A-A-G-P-G-C-P-P-G-P-A-G-G-A-P-P-P-A-A-A-P-G-G-A | 5.89 | 20.3 | 675 |
| OH-4867-31_102 | A-G-C-C-G-P-P-C-A-A-G-P-G-C-P-P-P-A-G-G-A-P-P-P-A-A-A-P-G-G-A | NB | — | 676 |
| OH-4867-31_103 | A-G-C-C-G-P-P-C-A-A-G-P-G-C-P-P-G-P-A-G-G-A-P-P-P-A-A-A-P-G-G-A | NB | — | 677 |
| OH-4867-31_145 | C-C-G-P-P-A-A-G-P-G-C-P-P-G-P-A-G-G-A-P-P-P-A-A-A-P-G-G-A | 3.08 | 10.6 | 678 |
| OH-4867-31_146 | C-C-G-P-P-G-A-A-G-P-G-C-P-P-G-P-A-G-G-A-P-P-P-A-A-A-P-G-G-A | 5.98 | 20.6 | 679 |
| OH-4867-31_147 | C-C-G-P-P-T-A-A-G-P-G-C-P-P-G-P-A-G-G-A-P-P-P-A-A-A-P-G-G-A | 3.28 | 11.3 | 680 |
| OH-4867-31_148 | C-C-G-P-P-C-A-A-G-P-G-C-P-P-A-P-A-G-G-A-P-P-P-A-A-A-P-G-G-A | 0.53 | 1.8 | 681 |
| OH-4867-31_149 | C-C-G-P-P-C-A-A-G-P-G-C-P-P-C-P-A-G-G-A-P-P-P-A-A-A-P-G-G-A | 0.27 | 0.9 | 682 |
| OH-4867-31_150 | C-C-G-P-P-C-A-A-G-P-G-C-P-P-T-P-A-G-G-A-P-P-P-A-A-A-P-G-G-A | 0.24 | 0.8 | 683 |
| OH-4867-31_151 | C-C-G-P-P-C-A-A-G-P-G-C-P-P-G-P-A-A-G-A-P-P-P-A-A-A-P-G-G-A | 0.16 | 0.6 | 684 |
| OH-4867-31_152 | C-C-G-P-P-C-A-A-G-P-G-C-P-P-G-P-A-C-G-A-P-P-P-A-A-A-P-G-G-A | 0.32 | 1.1 | 685 |
| OH-4867-31_153 | C-C-G-P-P-C-A-A-G-P-G-C-P-P-G-P-A-T-G-A-P-P-P-A-A-A-P-G-G-A | 0.21 | 0.7 | 686 |

TABLE 13

Single 2'-O-methyl Nap-U Substitutions, and multiple 2'-O-methyl substitutions in VEGF aptamer 4867-31_143

| Aptamer ID. No. | Sequence 5'→ 3' | $K_d$ (M) | ratio to parent | % Activity Remaining | Seq. ID. NO. |
|---|---|---|---|---|---|
| 4867-31_143 | C-C-G-P-P-C-A-A-G-P-G-C-P-P-G-P-A-G-G-A-P-P-P-A-A-A-P-G-G | 1.4E-10 | 1.0 | 12%, 7% | 586 |

TABLE 13-continued

Single 2'-O-methyl Nap-U Substitutions, and multiple 2'-O-methyl substitutions in VEGF aptamer 4867-31_143

| Aptamer ID. No. | Sequence 5'→ 3' | $K_d$ (M) | ratio to parent | % Activity Remaining | Seq. ID. NO. |
|---|---|---|---|---|---|
| 4867-31_154 | C-C-G-P$^1$-P-C-A-A-G-P-G-C-P-P-G-P-A-G-G-A-P-P-P-A-A-A-P-G-G | 5.9E-09 | 44 | | 687 |
| 4867-31_155 | C-C-G-P-P$^1$-C-A-A-G-P-G-C-P-P-G-P-A-G-G-A-P-P-P-A-A-A-P-G-G | 3.3E-09 | 24 | | 688 |
| 4867-31_156 | C-C-G-P-P-C-A-A-G-P$^1$-G-C-P-P-G-P-A-G-G-A-P-P-P-A-A-A-P-G-G | 6.8E-10 | 5.0 | 52%, 74% | 689 |
| 4867-31_157 | C-C-G-P-P-C-A-A-G-P-G-C-P$^1$-P-G-P-A-G-G-A-P-P-P-A-A-A-P-G-G | 1.5E-09 | 11 | 54%, 101% | 690 |
| 4867-31_158 | C-C-G-P-P-C-A-A-G-P-G-C-P-P$^1$-G-P-A-G-G-A-P-P-P-A-A-A-P-G-G | 1.7E-09 | 12 | 59%, 106% | 691 |
| 4867-31_159 | C-C-G-P-P-C-A-A-G-P-G-C-P-P-G-P$^1$-A-G-G-A-P-P-P-A-A-A-P-G-G | 5.6E-10 | 4.1 | 7%, 64% | 692 |
| 4867-31_160 | C-C-G-P-P-C-A-A-G-P-G-C-P-P-G-P-A-G-G-A-P$^1$-P-P-A-A-A-P-G-G | 1.5E-09 | 11 | 52%, 95% | 693 |
| 4867-31_161 | C-C-G-P-P-C-A-A-G-P-G-C-P-P-G-P-A-G-G-A-P-P$^1$-P-A-A-A-P-G-G | 6.4E-11 | 0.47 | 5%, 4%, -2% | 694 |
| 4867-31_162 | C-C-G-P-P-C-A-A-G-P-G-C-P-P-G-P-A-G-G-A-P-P-P$^1$-A-A-A-P-G-G | 8.9E-09 | 65 | 84%, 117% | 695 |
| 4867-31_163 | C-C-G-P-P-C-A-A-G-P-G-C-P-P-G-P-A-G-G-A-P-P-P-A-A-A-P$^1$-G-G | 2.6E-10 | 1.9 | 53%, 45% | 696 |
| 4867-31_183 | C-C-G-P-P-C-A-A-G-P-G-C-P-P-V-P-A-V-G-A-P-P-P-A-A-A-P-G-G | 9.1E-11 | 0.67 | 15% | 697 |
| 4867-31_184 | C-C-G-P-P-C-A-A-G$^1$-P-G-C-P-P-V-P-A$^1$-V-G-A-P-P-P-A-A-A-P-G-G | 8.4E-11 | 0.62 | 7% | 698 |
| 4867-31_185 | C-C-G-P-P-C$^1$-A-A-G$^1$-P-G-C$^1$-P-P-V-P-A$^1$-V-G-A-P-P-P-A-A-A-P-G$^1$-G$^1$ | 2.6E-10 | 1.9 | 50% | 699 |
| 4867-31_186 | C$^1$-C-G-P-P-C$^1$-A-A-G$^1$-P-G-C$^1$-P-P-V-P-A$^1$-V-G-A-P-P-P-A-A$^1$-A-P-G$^1$-G$^1$ | 1.6E-09 | 12 | 77% | 700 |
| 4867-31_187 | C-C-G-P-P-C-A-A-G$^1$-P-G-C-P-P-V-P-A$^1$-G-G-A-P-P-P-A-A-A-P-G-G | 3.2E-11 | 0.24 | -2% | 701 |
| 4867-31_188 | C-C-G-P-P-C$^1$-A-A-G$^1$-P-G-C$^1$-P-P-V-P-A$^1$-G$^1$-G-A-P-P-P-A-A-A-P-G$^1$-G$^1$ | 3.8E-11 | 0.28 | -2% | 702 |
| 4867-31_189 | C$^1$-C-G-P-P-C$^1$-A-A-G$^1$-P-G-C$^1$-P-P-V-P-A$^1$-G$^1$-G-A-P-P-P-A-A$^1$-A-P-G$^1$-G$^1$ | 9.0E-10 | 6.6 | 13% | 703 |

TABLE 14

Multiple 2'-O-methyl substitutions in VEGF aptamer 4867-31_143

| Aptamer ID. No. | Sequence 5'→3' | $K_d$ (M) | Ratio to 4867-31_188 | Seq. ID. NO. |
|---|---|---|---|---|
| 4867-31_188 | C-C-G-P-P-C$^1$-A-A-G$^1$-P-G-C$^1$-P-P-V-P-A$^1$-G$^1$-G-A-P-P-P-A-A-A-P-G$^1$-G$^1$ | 4.8E-11 | 1.0 | 702 |
| 4867-31_190 | C-C-G-P-P-C-A-A-G$^1$-P-G-C$^1$-P-P-V-P-A$^1$-G$^1$-G-A-P-P$^1$-P-A-A-A-P-G$^1$-G$^1$ | 8.9E-11 | 1.9 | 704 |
| 4867-31_191 | C-C-G-P-P-C$^1$-A-A-G$^1$-P-G-C$^1$-P-P-G$^1$-P-A$^1$-G$^1$-G-A-P-P-P-A-A-A-P-G$^1$-G$^1$ | 1.0E-10 | 2.1 | 705 |

TABLE 14-continued

Multiple 2'-O-methyl substitutions in VEGF aptamer 4867-31_143

| Aptamer ID. No. | Sequence 5'→3' | $K_d$ (M) | Ratio to 4867-31_188 | Seq. ID. NO. |
|---|---|---|---|---|
| 4867-31_192 | C-C-G-P-P-C$^1$-A-A-G$^1$-P-G-C$^1$-P-P-G$^1$-P-A$^1$-G$^1$-G-A-P-P$^1$-P-A-A-A-P-G$^1$-G$^1$ | 3.5E-11 | 0.7 | 706 |

TABLE 15

PDGF homodimers of 4149-8_379 and 5169-4_26.

| Aptamer ID. No. | Sequence (5' →3') | $K_i$ (pM) | Seq. ID. NO. |
|---|---|---|---|
| 4149-8_438 | Z-M-A$^1$-C-H-G-Z$^1$-Z-A-C-CS-C$^1$-G-C-G-Z-Z-Z$^1$-A$^1$-Z-A$^1$-G-C-G$^1$-Z-M-A$^1$-C-H-G-Z$^1$-Z-A-C-C3-C$^1$-G-C-G-Z-Z-Z$^1$-A$^1$-Z-A$^1$-G-C-G$^1$ | 4.2 | 707 |
| 4149-8_439 | Z-M-A$^1$-C-H-G-Z$^1$-Z-A-C-C3-C$^1$-G-C-G-Z-Z-Z$^1$-A$^1$-Z-A$^1$-G-C-G$^1$-H-Z-M-A$^1$-C-H-G-Z$^1$-Z-A-C-C3-C$^1$-G-C-G-Z-Z-Z$^1$-A$^1$-Z-A$^1$-G-C-G$^1$ | 3.5 | 708 |
| 4149-8_440 | Z-M-A$^1$-C-H-G-Z$^1$-Z-A-C-C3-C$^1$-G-C-G-Z-Z-Z$^1$-A$^1$-Z-A$^1$-G-C-G$^1$-H-H-Z-M-A$^1$-C-H-G-Z$^1$-Z-A-C-C3-C$^1$-G-C-G-Z-Z-Z$^1$-A$^1$-Z-A$^1$-G-C-G$^1$ | 1.4 | 709 |
| 4149-8_441 | Z-M-A$^1$-C-H-G-Z$^1$-Z-A-C-C3-C$^1$-G-C-G-Z-Z-Z$^1$-A$^1$-Z-A$^1$-G-C-G$^1$-H-H-H-Z-M-A$^1$-C-H-G-Z$^1$-Z-A-C-C3-C$^1$-G-C-G-Z-Z-Z$^1$-A$^1$-Z-A$^1$-G-C-G$^1$ | 0.78 | 710 |
| 4149-8_442 | Z-M-A$^1$-C-H-G-Z$^1$-Z-A-C-C3-C$^1$-G-C-G-Z-Z-Z$^1$-A$^1$-Z-A$^1$-G-C-G$^1$-H-H-H-H-Z-M-A$^1$-C-H-G-Z$^1$-Z-A-C-C3-C$^1$-G-C-G-Z-Z-Z$^1$-A$^1$-Z-A$^1$-G-C-G$^1$ | 0.51 | 711 |
| 4149-8_443 | Z-M-A$^1$-C-H-G-Z$^1$-Z-A-C-C3-C$^1$-G-C-G-Z-Z-Z$^1$-A$^1$-Z-A$^1$-G-C-G$^1$-H-H-H-H-H-Z-M-A$^1$-C-H-G-Z$^1$-Z-A-C-C3-C$^1$-G-C-G-Z-Z-Z$^1$-A$^1$-Z-A$^1$-G-C-G$^1$ | 0.25 | 712 |
| 4149-8_444 | Z-M-A$^1$-C-H-G-Z$^1$-Z-A-C-C3-C$^1$-G-C-G-Z-Z-Z$^1$-A$^1$-Z-A$^1$-G-C-G$^1$-H-H-H-H-H-Z-M-A$^1$-C-H-G-Z$^1$-Z-A-C-C3-C$^1$-G-C-G-Z-Z-Z$^1$-A$^1$-Z-A$^1$-G-C-G$^1$ | 0.61 | 713 |
| 4149-8_379D | Z-M-A$^1$-C-H-G-Z$^1$-Z-A-C-C3-C$^1$-G-C-G-Z-Z-Z$^1$-A$^1$-Z-A$^1$-G-C-G$^1$-G$^1$-C-G-A$^1$-Z-A$^1$-Z-Z-G-C-G-C$^1$-C3-C-A-Z-Z$^1$-G-H-C-A$^1$-M-Z | 11 | 714 |
| 4149-8_445 | Z-M-A$^1$-C-H-G-Z$^1$-Z-A-C-C3-C$^1$-G-C-G-Z-Z-Z$^1$-A$^1$-Z-A$^1$-G-C-G$^1$-H-H-G$^1$-C-G-A$^1$-Z-A$^1$-Z$^1$-Z-Z-G-C-G-C$^1$-CS-C-A-Z-Z$^1$-G-H-C-A$^1$-M-Z | 1.1 | 715 |
| 4149-8_446 | Z-M-A$^1$-C-H-G-Z$^1$-Z-A-C-C3-C$^1$-G-C-G-Z-Z-Z$^1$-A$^1$-Z-A$^1$-G-C-G$^1$-H-H-H-H-G$^1$-C-G-A$^1$-Z-A$^1$-Z$^1$-Z-Z-G-C-G-C$^1$-C3-C-A-Z-Z$^1$-G-H-C-A$^1$-M-Z | 0.61 | 716 |
| 4149-8_447 | Z-M-A$^1$-C-H-G-Z$^1$-Z-A-C-C3-C$^1$-G-C-G-Z-Z-Z$^1$-A$^1$-Z-A$^1$-G-C-G$^1$-H-H-H-H-H-G$^1$-C-G-A$^1$-Z-A$^1$-Z$^1$-Z-Z-G-C-G-C$^1$-C3-C-A-Z-Z$^1$-G-H-C-A$^1$-M-Z | 0.88 | 717 |
| 5169-4_134 | C-G-A-C-A-G-C-A-P-G-P-A-P-G-C-A-C-A-P-C-P-C-G-A-C-A-G-C-A-P-G-P-A-P-G-C-A-C-A-P-C-P | 28 | 718 |
| 5169-4_135 | C-G-A-C-A-G-C-A-P-G-P-A-P-G-C-A-C-A-P-C-P-H-C-G-A-C-A-G-C-A-P-G-P-A-P-G-C-A-C-A-P-C-P | 9.3 | 719 |
| 5169-4_136 | C-G-A-C-A-G-C-A-P-G-P-A-P-G-C-A-C-A-P-C-P-H-H-C-G-A-C-A-G-C-A-P-G-P-A-P-G-C-A-C-A-P-C-P | 8.7 | 720 |

TABLE 15-continued

PDGF homodimers of 4149-8_379 and 5169-4_26.

| Aptamer ID. No. | Sequence (5' →3') | $K_i$ (pM) | Seq. ID. NO. |
|---|---|---|---|
| 5169-4_137 | C-G-A-C-A-G-C-A-P-G-P-A-P-G-C-A-C-A-P-C-P-H-H-H-C-G-A-C-A-G-C-A-P-G-P-A-P-G-C-A-C-A-P-C-P | 5.1 | 721 |
| 5169-4_138 | C-G-A-C-A-G-C-A-P-G-P-A-P-G-C-A-C-A-P-C-P-H-H-H-H-C-G-A-C-A-G-C-A-P-G-P-A-P-G-C-A-C-A-P-C-P | 4.9 | 722 |
| 5169-4_139 | C-G-A-C-A-G-C-A-P-G-P-A-P-G-C-A-C-A-P-C-P-H-H-H-H-H-C-G-A-C-A-G-C-A-P-G-P-A-P-G-C-A-C-A-P-C-P | 3.6 | 723 |
| 5169-4_140 | C-G-A-C-A-G-C-A-P-G-P-A-P-G-C-A-C-A-P-C-P-H-H-H-H-H-H-C-G-A-C-A-G-C-A-P-G-P-A-P-G-C-A-C-A-P-C-P | 3.6 | 724 |
| 5169-4_26D | C-G-A-C-A-G-C-A-P-G-P-A-P-G-C-A-C-A-P-C-P-P-C-P-A-C-A-C-G-P-A-P-G-P-A-C-G-A-C-A-G-C | 11 | 725 |
| 5169-4_141 | C-G-A-C-A-G-C-A-P-G-P-A-P-G-C-A-C-A-P-C-P-H-P-C-P-A-C-A-C-G-P-A-P-G-P-A-C-G-A-C-A-G-C | 13 | 726 |
| 5169-4_142 | C-G-A-C-A-G-C-A-P-G-P-A-P-G-C-A-C-A-P-C-P-H-H-H-P-C-P-A-C-A-C-G-P-A-P-G-P-A-C-G-A-C-A-G-C | 5.5 | 727 |
| 5169-4_143 | C-G-A-C-A-G-C-A-P-G-P-A-P-G-C-A-C-A-P-C-P-H-H-H-H-H-P-C-P-A-C-A-C-G-P-A-P-G-P-A-C-G-A-C-A-G-C | 2.0 | 728 |

TABLE 16

VEGF homodimers of 4867-31_192.

| Aptamer ID. No. | Sequence (5'→ 3') | $K_i$ (pM) | Seq. ID. NO. |
|---|---|---|---|
| 4867-31_395 | C-C-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$-C-C-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$ | 6.8 | 729 |
| 4867-31_396 | C-C-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$-H-C-C-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$ | 50 | 730 |
| 4867-31_397 | C-C-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$-H-H-C-C-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$ | 43 | 731 |
| 4867-31_398 | C-C-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$-H-H-H-C-C-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$ | 29 | 732 |
| 4867-31_399 | C-C-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$-H-H-H-H-C-C-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$ | 22 | 733 |
| 4867-31_400 | C-C-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$-H-H-H-H-H-C-C-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$ | 14 | 734 |

TABLE 16-continued

VEGF homodimers of 4867-31_192.

| Aptamer ID. No. | Sequence (5'→ 3') | $K_i$ (pM) | Seq. ID. NO. |
|---|---|---|---|
| 4867-31_401 | C-C-G-P-P-C$^1$-A-A-G$^1$-P-G-C$^1$-P-P-G$^1$-P-A$^1$-G$^1$-G-A-P-P$^1$-P-A-A-A-P-G$^1$-G$^1$-H-H-H-H-H-C-C-G-P-P-C$^1$-A-A-G$^1$-P-G-C$^1$-P-P-G$^1$-P-A$^1$-G$^1$-G-A-P-P$^1$-P-A-A-A-P-G$^1$-G$^1$ | 21 | 735 |
| 4867-31_192D | C-C-G-P-P-C$^1$-A-A-G$^1$-P-G-C$^1$-P-P-G$^1$-P-A$^1$-G$^1$-G-A-P-P$^1$-P-A-A-A-P-G$^1$-G$^1$-G$^1$-G$^1$-P-A-A-A-P-P$^1$-P-A-G-G$^1$-A$^1$-P-G$^1$-P-P-C$^1$-G-P-G$^1$-A-A-C$^1$-P-P-G-C-C | 32 | 736 |
| 4867-31_402 | C-C-G-P-P-C$^1$-A-A-G$^1$-P-G-C$^1$-P-P-G$^1$-P-A$^1$-G$^1$-G-A-P-P$^1$-P-A-A-A-P-G$^1$-G$^1$-H-H-G$^1$-G$^1$-P-A-A-A-P-P$^1$-P-A-G-G$^1$-A$^1$-P-G$^1$-P-P-C$^1$-G-P-G$^1$-A-A-C$^1$-P-P-G-C-C | 27 | 737 |
| 4867-31_403 | C-C-G-P-P-C$^1$-A-A-G$^1$-P-G-C$^1$-P-P-G$^1$-P-A$^1$-G$^1$-G-A-P-P$^1$-P-A-A-A-P-G$^1$-G$^1$-H-H-H-H-G$^1$-G$^1$-P-A-A-A-P-P$^1$-P-A-G-G$^1$-A$^1$-P-G$^1$-P-P-C$^1$-G-P-G$^1$-A-A-C$^1$-P-P-G-C-C | 20 | 738 |
| 4867-31_404 | C-C-G-P-P-C$^1$-A-A-G$^1$-P-G-C$^1$-P-P-G$^1$-P-A$^1$-G$^1$-G-A-P-P$^1$-P-A-A-A-P-G$^1$-G$^1$-H-H-H-H-H-G$^1$-G$^1$-P-A-A-A-P-P$^1$-P-A-G-G$^1$-A$^1$-P-G$^1$-P-P-C$^1$-G-P-G$^1$-A-A-C$^1$-P-P-G-C-C | 33 | 739 |

TABLE 17

PDGF-VEGF aptamer constructs

| Aptamer ID. No. | Sequence 5'→ 3' | Seq. ID. NO. |
|---|---|---|
| 4149-8_313 | C-C-G-P-P-C-A-A-G-P-G-C-P-P-C3-P-A-C3-G-A-P-P-P-A-A-A-P-G-G-Z-Z-A$^1$-C-H-G-Z-Z-A-C-A$^1$-C$^1$-G-C-G-Z-Z-Z-A$^1$-Z-A$^1$-G-C | 740 |
| 4149-8_314 | C-C-G-P-P-C-A-A-G-P-G-C-P-P-C3-P-A-C3-G-A-P-P-P-A-A-A-P-G-G-H-Z-Z-A$^1$-C-H-G-Z-Z-A-C-A$^1$-C$^1$-G-C-G-Z-Z-Z-A$^1$-Z-A$^1$-G-C | 741 |
| 4149-8_315 | C-C-G-P-P-C-A-A-G-P-G-C-P-P-C3-P-A-C3-G-A-P-P-P-A-A-A-P-G-G-H-H-Z-Z-A$^1$-C-H-G-Z-Z-A-C-A$^1$-C$^1$-G-C-G-Z-Z-Z-A$^1$-Z-A$^1$-G-C | 742 |
| 4149-8_316 | C-C-G-P-P-C-A-A-G-P-G-C-P-P-C3-P-A-C3-G-A-P-P-P-A-A-A-P-G-G-H-H-H-Z-Z-A$^1$-C-H-G-Z-Z-A-C-A$^1$-C$^1$-G-C-G-Z-Z-Z-A$^1$-Z-A$^1$-G-C | 743 |
| 4149-8_317 | Z-Z-A$^1$-C-H-G-Z-Z-A-C-A$^1$-C$^1$-G-C-G-Z-Z-Z-A$^1$-Z-A$^1$-G-C-G$^1$-C-C-G-P-P-C-A-A-G-P-G-C-P-P-C3-P-A-C3-G-A-P-P-P-A-A-A-P-G | 744 |
| 4149-8_318 | Z-Z-A$^1$-C-H-G-Z-Z-A-C-A$^1$-C$^1$-G-C-G-Z-Z-Z-A$^1$-Z-A$^1$-G-C-G$^1$-H-C-C-G-P-P-C-A-A-G-P-G-C-P-P-C3-P-A-C3-G-A-P-P-P-A-A-A-P-G | 745 |
| 4149-8_319 | Z-Z-A$^1$-C-H-G-Z-Z-A-C-A$^1$-C$^1$-G-C-G-Z-Z-Z-A$^1$-Z-A$^1$-G-C-G$^1$-H-H-C-C-G-P-P-C-A-A-G-P-G-C-P-P-C3-P-A-C3-G-A-P-P-P-A-A-A-P-G | 746 |
| 4149-8_320- | Z-Z-A$^1$-C-H-G-Z-Z-A-C-A$^1$-C$^1$-G-C-G-Z-Z-Z-A$^1$-Z-A$^1$-G-C-G$^1$-H-H-H-C-C-G-P-P-C-A-A-G-P-G-C-P-P-C3-P-A-C3-G-A-P-P-P-A-A-A-P-G | 747 |

TABLE 18

Binding affinity and in vitro activity of PDGF-VEGF aptamer constructs.

| Target | SeqID | PDGF-BB Kd (M) | Hs27 PDGFRβ % Activity Remaining | PDGF-AB Kd (M) | VEGF Kd (M) | VEGF121 Kd (M) |
|---|---|---|---|---|---|---|
| PDGF-BB | 4149-8_39 | 8.75E−11 | | 4.76E−11 | 1.00E−06 | 1.00E−06 |
| PDGF-BB | 4149-8_130 | 7.59E−11 | | 1.41E−10 | 1.00E−06 | 1.00E−06 |
| PDGF-BB | 4149-8_273 | 6.14E−11 | | 1.89E−10 | 1.00E−06 | 1.00E−06 |
| VEGF121 | 4867-31_51 | 1.26E−07 | | 1.48E−08 | 1.96E−10 | 7.28E−10 |
| VEGF121 | 4867-31_183 | 1.95E−07 | | 1.45E−08 | 1.38E−10 | 6.65E−10 |

TABLE 18-continued

Binding affinity and in vitro activity of PDGF-VEGF aptamer constructs.

| Target | SeqID | PDGF-BB Kd (M) | Hs27 PDGFRβ % Activity Remaining | PDGF-AB Kd (M) | VEGF Kd (M) | VEGF121 Kd (M) |
|---|---|---|---|---|---|---|
| Both | 4149-8_313 | 9.33E-11 | 5% | 1.65E-10 | 2.58E-10 | 4.31E-09 |
| Both | 4149-8_314 | 1.36E-10 | 2% | 1.11E-10 | 1.43E-10 | 1.55E-09 |
| Both | 4149-8_315 | 1.19E-10 | 2% | 1.23E-10 | 8.60E-11 | 7.58E-10 |
| Both | 4149-8_316 | 8.97E-11 | 2% | 1.37E-10 | 1.57E-10 | 5.00E-10 |
| Both | 4149-8_317 | 6.38E-11 | 58% | | | 8.09E-11 |
| Both | 4149-8_318 | 4.31E-11 | 43% | 8.18E-11 | 2.70E-10 | 2.47E-09 |
| Both | 4149-8_319 | 2.42E-11 | 17% | 3.02E-11 | 1.25E-10 | 1.07E-09 |
| Both | 4149-8_320 | 1.50E-11 | 13% | 4.93E-11 | 7.68E-11 | 4.22E-10 |

TABLE 19

PDGF/VEGF aptamer construct 4149-8_401

| Aptamer ID. No. | Sequence 5'→3' | Seq. ID. NO. |
|---|---|---|
| 4149-8_401 | Z-M-$A^1$-C-H-G-$Z^1$-Z-A-C-C3-$C^1$-G-C-G-Z-Z-$Z^1$-$A^1$-Z-$A^1$-G-C-$G^1$-H-H-H-C-C-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$ | 748 |

TABLE 20

Binding affinity of PDGF/VEGF aptamer construct 4149-8_401

| Target | Seq ID | PDGF-BB Kd (M) | PDGF-AB Kd (M) | VEGF165 Kd (M) | VEGF121 Kd (M) |
|---|---|---|---|---|---|
| Both | 4149-8_320 | 1.50E-11 | 4.93E-11 | 7.68E-11 | 4.22E-10 |
| Both | 4149-8_401 | 1.51E-11 | 1.93E-10 | 2.77E-10 | 3.74E-11 |

TABLE 21

Binding affinities of PDGF/VEGF aptamer constructs comprising 4149-8_379 and 4867-31_192

| 4149-8_401 | PDGF_379 | HHH | VEGF_192 |
|---|---|---|---|
| 4149-8_408 | VEGF_192 | H | PDGF_379 |
| 4149-8_409 | VEGF_192 | HH | PDGF_379 |
| 4149-8_410 | VEGF_192 | HHH | PDGF_379 |
| 4149-8_411 | VEGF_192 | HHHH | PDGF_379 |
| 4149-8_412 | VEGF_192 | HHHHH | PDGF_379 |
| 4149-8_413 | VEGF_192 | HHHHHH | PDGF_379 |
| 4149-8_414 | PDGF_379 | HH | VEGF_192 |
| 4149-8_415 | PDGF_379 | HHHH | VEGF_192 |
| 4149-8_416 | PDGF_379 | HHHHH | VEGF_192 |
| 4149-8_417 | PDGF_379 | HHHHHH | VEGF_192 |

| Aptamer ID. No. | Kd (M) PDGF-BB | Kd (M) VEGF121 | Kd (M) VEGF165 |
|---|---|---|---|
| E10030 | 4.7E-11 | NB | NB |
| OH-4149-8_379 | 2.0E-11 | NB | NB |
| OH-4867-31_192 | 5.7E-08 | 2.3E-11 | 4.1E-11 |
| N-4149-8_401 | 5.6E-12 | 2.7E-11 | 2.5E-11 |
| OH-4149-8_408 | 4.3E-11 | 4.4E-11 | 4.1E-11 |
| OH-4149-8_409 | 6.0E-10 | 2.6E-11 | 2.9E-11 |
| OH-4149-8_410 | 2.0E-11 | 2.6E-11 | 3.3E-11 |
| OH-4149-8_411 | 7.2E-12 | 2.0E-11 | 4.5E-11 |
| OH-4149-8_412 | 8.6E-12 | 2.0E-11 | 4.5E-11 |
| OH-4149-8_413 | 1.0E-11 | 4.0E-11 | 6.3E-11 |
| OH-4149-8_414 | 1.0E-11 | 2.3E-11 | 5.1E-11 |
| OH-4149-8_415 | 8.1E-12 | 4.0E-11 | 3.0E-11 |
| OH-4149-8_416 | 8.9E-12 | 4.1E-11 | 3.0E-11 |
| OH-4149-8_417 | 1.1E-11 | 4.3E-11 | 6.5E-11 |

TABLE 22

Binding affinities of PDGF/VEGF aptamer constructs comprising 5169-4_26 and 4867-31_192.

| Aptamer ID. No. | Sequence (5'→3') | $K_d$ (nM) PDGF | $K_d$ (nM) VEGF121 | Seq. ID. NO. |
|---|---|---|---|---|
| 5169-4_93 | C-C-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$-H-H-H-H-H-H-C-G-A-C-A-G-C-A-P-G-P-A-P-G-C-A-C-A-P-C-P | 0.00020 | 0.052 | 749 |
| 5169-4_94 | C-C-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$-H-H-H-H-C-G-A-C-A-G-C-A-P-G-P-A-P-G-C-A-C-A-P-C-P | 0.00050 | 0.066 | 750 |
| 5169-4_95 | C-C-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$-H-H-H-H-C-G-A-C-A-G-C-A-P-G-P-A-P-G-C-A-C-A-P-C-P | 0.0012 | 0.043 | 751 |

TABLE 22-continued

Binding affinities of PDGF/VEGF aptamer constructs comprising 5169-4_26 and 4867-31_192.

| Aptamer ID. No. | Sequence (5'→3') | $K_d$ (nM) PDGF | $K_d$ (nM) VEGF121 | Seq. ID. NO. |
|---|---|---|---|---|
| 5169-4_96 | C-C-G-P-P-C$^1$-A-A-G$^1$-P-G-C$^1$-P-P-G$^1$-P-A$^1$-G$^1$-G-A-P-P$^1$-P-A-A-A-P-G$^1$-G$^1$-H-H-H-C-G-A-C-A-G-C-A-P-G-P-A-P-G-C-A-C-A-P-C-P | 0.0045 | 0.076 | 752 |
| 5169-4_97 | C-C-G-P-P-C$^1$-A-A-G$^1$-P-G-C$^1$-P-P-G$^1$-P-A$^1$-G$^1$-G-A-P-P$^1$-P-A-A-A-P-G$^1$-G$^1$-H-H-C-G-A-C-A-G-C-A-P-G-P-A-P-G-C-A-C-A-P-C-P | 0.0037 | 0.10 | 753 |
| 5169-4_98 | C-C-G-P-P-C$^1$-A-A-G$^1$-P-G-C$^1$-P-P-G$^1$-P-A$^1$-G$^1$-G-A-P-P$^1$-P-A-A-A-P-G$^1$-G$^1$-H-C-G-A-C-A-G-C-A-P-G-P-A-P-G-C-A-C-A-P-C-P | 0.0053 | 0.14 | 754 |
| 5169-4_99 | C-G-A-C-A-G-C-A-P-G-P-A-P-G-C-A-C-A-P-C-P-H-H-H-H-H-C-C-G-P-P-C$^1$-A-A-G$^1$-P-G-C$^1$-P-P-G$^1$-P-A$^1$-G$^1$-G-A-P-P$^1$-P-A-A-A-P-G$^1$-G$^1$ | 0.0021 | 0.120 | 755 |
| 5169-4_100 | C-G-A-C-A-G-C-A-P-G-P-A-P-G-C-A-C-A-P-C-P-H-H-H-H-H-C-C-G-P-P-C$^1$-A-A-G$^1$-P-G-C$^1$-P-P-G$^1$-P-A$^1$-G$^1$-G-A-P-P$^1$-P-A-A-A-P-G$^1$-G$^1$ | 0.0015 | 0.056 | 756 |
| 5169-4_101 | C-G-A-C-A-G-C-A-P-G-P-A-P-G-C-A-C-A-P-C-P-H-H-H-H-C-C-G-P-P-C$^1$-A-A-G$^1$-P-G-C$^1$-P-P-G$^1$-P-A$^1$-G$^1$-G-A-P-P$^1$-P-A-A-A-P-G$^1$-G$^1$ | 0.00050 | 0.13 | 757 |
| 5169-4_102 | C-G-A-C-A-G-C-A-P-G-P-A-P-G-C-A-C-A-P-C-P-H-H-H-C-C-G-P-P-C$^1$-A-A-G$^1$-P-G-C$^1$-P-P-G$^1$-P-A$^1$-G$^1$-G-A-P-P$^1$-P-A-A-A-P-G$^1$-G$^1$ | 0.011 | 0.14 | 758 |
| 5169-4_103 | C-G-A-C-A-G-C-A-P-G-P-A-P-G-C-A-C-A-P-C-P-H-H-C-C-G-P-P-C$^1$-A-A-G$^1$-P-G-C$^1$-P-P-G$^1$-P-A$^1$-G$^1$-G-A-P-P$^1$-P-A-A-A-P-G$^1$-G$^1$ | 0.0061 | 0.12 | 759 |
| 5169-4_104 | C-G-A-C-A-G-C-A-P-G-P-A-P-G-C-A-C-A-P-C-P-H-C-C-G-P-P-C$^1$-A-A-G$^1$-P-G-C$^1$-P-P-G$^1$-P-A$^1$-G$^1$-G-A-P-P$^1$-P-A-A-A-P-G$^1$-G$^1$ | 0.0046 | 0.28 | 760 |

TABLE 23

Aptamers and aptamer constructs tested in Ocular PK Studies.

| Test Article | Sequence ID | Target(s) | PEG |
|---|---|---|---|
| SL1010 | 4867-31_192 | VEGF | 40 kDa |
| SL1011 | 4149-8_379 | PDGF | 40 kDa |
| SL1012 | 4149-8_401 | VEGF and PDGF | 20 kDa |
| SL1013 | 4149-8_401 | VEGF and PDGF | 40 kDa |

TABLE 24

Concentrations in the Vitreous Humor For Aptamer and Aptamer Constructs in the Ocular Pharmacokinetic Studies.

| Time Point (hours) | EYE (OS or OD) | SL1010 Concentration (µg/mL) | SL1011 Concentration (µg/mL) | SL1012 Concentration (µg/mL) | SL1013 Concentration (µg/mL) |
|---|---|---|---|---|---|
| 2 | OS | 296 | 280 | 538 | 563 |
| 2 | OD | 296 | 298 | 682 | 634 |
| 24 | OS | 195 | 164 | 330 | 520 |
| 24 | OD | 198 | 165 | 433 | 493 |

TABLE 24-continued

Concentrations in the Vitreous Humor For Aptamer and Aptamer Constructs in the Ocular Pharmacokinetic Studies.

| Time Point (hours) | EYE (OS or OD) | SL1010 Concentration (µg/mL) | SL1011 Concentration (µg/mL) | SL1012 Concentration (µg/mL) | SL1013 Concentration (µg/mL) |
|---|---|---|---|---|---|
| 48 | OS | 188 | 131 | 359 | 376 |
| 48 | OD | 207 | 116 | 267 | 336 |
| 96 | OS | 146 | 96.3 | 227 | 307 |
| 96 | OD | 139 | 97.8 | 204 | 277 |
| 192 | OS | 70.2 | 16.8 | 92.8 | 145 |
| 192 | OD | 82.4 | 18.2 | 67.8 | 132 |

OS—Oculus Sinister;
OD—Oculus Dexter

TABLE 25

Vitreous Humor Half-Life for Aptamer and Aptamer Constructs Following a Single Bilateral Intravitreous Dose to NZW Rabbits.

| Test Article | Half-life (hours) | 95% Confidence Interval |
|---|---|---|
| SL1010 | 105 | 90-128 |
| SL1011 | 47 | 42-55 |
| SL1012 | 69 | 58-85 |
| SL1013 | 92 | 81-106 |

TABLE 26

Phosphorothioate walk along aptamer 4867-31_192.

| Aptamer ID. No. | Sequence (5' → 3') | SEQ ID NO. | $K_d$ (M) | Ratio to parent |
|---|---|---|---|---|
| 4867-31_192 | C-C-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$ | 706 | 1.1E-11 | 1 |
| 4867-31_409 | $C^2$-C-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$ | 763 | 1.1E-11 | 0.97 |
| 4867-31_410 | C-$C^2$-G-P-P-$C^1$-A-A-$G^1$-P-G-$C^1$-P-P-$G^1$-P-$A^1$-$G^1$-G-A-P-$P^1$-P-A-A-A-P-$G^1$-$G^1$ | 764 | 1.6E-11 | 1.5 |
| 4867-31_411 | C-C-$G^2$-P-P-$C^1$-A-A-$G^1$-P-G-$C^1$-P-P-$G^1$-P-$A^1$-$G^1$-G-A-P-$P^1$-P-A-A-A-P-$G^1$-$G^1$ | 765 | 3.2E-07 | 29,259 |
| 4867-31_412 | C-C-G-$P^2$-P-$C^1$-A-A-$G^1$-P-G-$C^1$-P-P-$G^1$-P-$A^1$-$G^1$-G-A-P-$P^1$-P-A-A-A-P-$G^1$-$G^1$ | 766 | 2.2E-11 | 2.1 |
| 4867-31_413 | C-C-G-P-$P^2$-$C^1$-A-A-$G^1$-P-G-$C^1$-P-P-$G^1$-P-$A^1$-$G^1$-G-A-P-$P^1$-P-A-A-A-P-$G^1$-$G^1$ | 767 | 1.5E-11 | 1.4 |
| 4867-31_414 | C-C-G-P-P-$C^1$-$A^2$-A-$G^1$-P-G-$C^1$-P-P-$G^1$-P-$A^1$-$G^1$-G-A-P-$P^1$-P-A-A-A-P-$G^1$-$G^1$ | 768 | 1.5E-11 | 1.4 |
| 4867-31_415 | C-C-G-P-P-$C^1$-A-$A^2$-$G^1$-P-G-$C^1$-P-P-$G^1$-P-$A^1$-$G^1$-G-A-P-$P^1$-P-A-A-A-P-$G^1$-$G^1$ | 769 | 1.1E-11 | 1.0 |
| 4867-31_416 | C-C-G-P-P-$C^1$-A-A-$G^1$-$P^2$-G-$C^1$-P-P-$G^1$-P-$A^1$-$G^1$-G-A-P-$P^1$-P-A-A-A-P-$G^1$-$G^1$ | 770 | 9.3E-12 | 0.86 |
| 4867-31_417 | C-C-G-P-P-$C^1$-A-A-$G^1$-P-$G^2$-$C^1$-P-P-$G^1$-P-$A^1$-$G^1$-G-A-P-$P^1$-P-A-A-A-P-$G^1$-$G^1$ | 771 | 9.4E-12 | 0.87 |
| 4867-31_419 | C-C-G-P-P-$C^1$-A-A-$G^1$-P-G-$C^1$-$P^2$-P-$G^1$-P-$A^1$-$G^1$-G-A-P-$P^1$-P-A-A-A-P-$G^1$-$G^1$ | 772 | no data | no data |
| 4867-31_420 | C-C-G-P-P-$C^1$-A-A-$G^1$-P-G-$C^1$-P-$P^2$-$G^1$-P-$A^1$-$G^1$-G-A-P-$P^1$-P-A-A-A-P-$G^1$-$G^1$ | 773 | 1.8E-11 | 1.6 |
| 4867-31_421 | C-C-G-P-P-$C^1$-A-A-$G^1$-P-G-$C^1$-P-P-$G^1$-$P^2$-$A^1$-$G^1$-G-A-P-$P^1$-P-A-A-A-P-$G^1$-$G^1$ | 774 | 1.5E-11 | 1.4 |
| 4867-31_422 | C-C-G-P-P-$C^1$-A-A-$G^1$-P-G-$C^1$-P-P-$G^1$-P-$A^1$-$G^2$-G-A-P-$P^1$-P-A-A-A-P-$G^1$-$G^1$ | 775 | 9.5E-12 | 0.88 |

TABLE 26-continued

Phosphorothioate walk along aptamer 4867-31_192.

| Aptamer ID. No. | Sequence (5'→ 3') | SEQ ID NO. | $K_d$ (M) | Ratio to parent |
|---|---|---|---|---|
| 4867-31_423 | C-C-G-P-P-C$^1$-A-A-G$^1$-P-G-C$^1$-P-P-G$^1$-P-A$^1$-G-A$^2$-P-P$^1$-P-A-A-A-P-G$^1$-G$^1$ | 776 | 1.8E-11 | 1.7 |
| 4867-31_424 | C-C-G-P-P-C$^1$-A-A-G$^1$-P-G-C$^1$-P-P-G$^1$-P-A$^1$-G-A-P$^2$-P$^1$-P-A-A-A-P-G$^1$-G$^1$ | 777 | 1.1E-11 | 1.1 |
| 4867-31_425 | C-C-G-P-P-C$^1$-A-A-G$^1$-P-G-C$^1$-P-P-G$^1$-P-A$^1$-G-A-P-P$^2$-A-A-A-P-G$^1$-G$^1$ | 778 | 1.6E-11 | 1.5 |
| 4867-31_426 | C-C-G-P-P-C$^1$-A-A-G$^1$-P-G-C$^1$-P-P-G$^1$-P-A$^1$-G-A-P-P$^1$-P-A$^2$-A-A-P-G$^1$-G$^1$ | 779 | 1.2E-11 | 1.1 |
| 4867-31_427 | C-C-G-P-P-C$^1$-A-A-G$^1$-P-G-C$^1$-P-P-G$^1$-P-A$^1$-G-A-P-P$^1$-P-A-A$^2$-A-P-G$^1$-G$^1$ | 780 | 8.1E-12 | 0.75 |
| 4867-31_428 | C-C-G-P-P-C$^1$-A-A-G$^1$-P-G-C$^1$-P-P-G$^1$-P-A$^1$-G-A-P-P$^1$-P-A-A-A$^2$-P-G$^1$-G$^1$ | 781 | 8.4E-12 | 0.78 |
| 4867-31_429 | C-C-G-P-P-C$^1$-A-A-G$^1$-P-G-C$^1$-P-P-G$^1$-P-A$^1$-G-A-P-P$^1$-P-A-A-A-P$^2$-G$^1$-G$^1$ | 782 | 1.2E-11 | 1.1 |
| 4867-31_438 | C-C-G-P-P-C$^{1,2}$-A-A-G$^1$-P-G-C$^1$-P-P-G$^1$-P-A$^1$-G-A-P-P$^1$-P-A-A-A-P-G$^1$-G$^1$ | 783 | 1.3E-11 | 1.2 |
| 4867-31_439 | C-C-G-P-P-C$^1$-A-A-G$^{1,2}$-P-G-C$^1$-P-P-G$^1$-P-A$^1$-G-A-P-P$^1$-P-A-A-A-P-G$^1$-G$^1$ | 784 | 2.4E-11 | 2.2 |
| 4867-31_440 | C-C-G-P-P-C$^1$-A-A-G$^1$-P-G-C$^{1,2}$-P-P-G$^1$-P-A$^1$-G-A-P-P$^1$-P-A-A-A-P-G$^1$-G$^1$ | 785 | 9.9E-12 | 0.91 |
| 4867-31_441 | C-C-G-P-P-C$^1$-A-A-G$^1$-P-G-C$^1$-P-P-G$^{1,2}$-P-A$^1$-G-A-P-P$^1$-P-A-A-A-P-G$^1$-G$^1$ | 786 | 1.7E-11 | 1.6 |
| 4867-31_442 | C-C-G-P-P-C$^1$-A-A-G$^1$-P-G-C$^1$-P-P-G$^1$-P-A$^{1,2}$-G-A-P-P$^1$-P-A-A-A-P-G$^1$-G$^1$ | 787 | 1.5E-11 | 1.4 |
| 4867-31_443 | C-C-G-P-P-C$^1$-A-A-G$^1$-P-G-C$^1$-P-P-G$^1$-P-A$^1$-G$^{1,2}$-G-A-P-P$^1$-P-A-A-A-P-G$^1$-G$^1$ | 788 | 8.5E-12 | 0.79 |
| 4867-31_444 | C-C-G-P-P-C$^1$-A-A-G$^1$-P-G-C$^1$-P-P-G$^1$-P-A$^1$-G-A-P-P$^1$-P-A-A-A-P-G$^{1,2}$-G$^1$ | 789 | 7.5E-12 | 0.70 |
| 4867-31_445 | C-C-G-P-P-C$^1$-A-A-G$^1$-P-G-C$^1$-P-P-G$^1$-P-A$^1$-G-A-P-P$^1$-P-A-A-A-P-G$^1$-G$^{1,2}$ | 790 | 1.0E-11 | 0.96 |

TABLE 27

Sequences of the VEGF aptamers created in order to enhance nuclease resistance. The binding dissociation constant ($K_d$ values) along with the number of 2'-OMe moieties (# OMe; superscript "1" indicates that the nucleotide has a 2'-O-methyl) and 3'-phosphorothioate linkages (# P=S; superscript "2" indicates that the nucleotide has a phosphorothioate linkage) are shown.

| Aptamer ID. No. | Sequence (5'→ 3') | SEQ ID NO. | $K_d$ (M) | # OMe | # P=S |
|---|---|---|---|---|---|
| 4867-31_192 | C-C-G-P-P-C$^1$-A-A-G$^1$-P-G-C$^1$-P-P-G$^1$-P-A$^1$-G-A-P-P$^1$-P-A-A-A-P-G$^1$-G$^1$ | 706 | 3.1E-11 | 9 | 0 |
| 4867-31_475 | C$^1$-C-G-P-P-C$^1$-A-A-G$^1$-P-G-C$^1$-P-P-G$^1$-P-A$^1$-G-A-P-P$^1$-P-A-A$^2$-A-P-G$^1$-G$^1$ | 791 | 2.6E-11 | 10 | 1 |
| 4867-31_476 | C$^1$-C-G-P-P-C$^1$-A-A-G$^1$-P-G-C$^1$-P-P-G$^1$-P-A$^1$-G-A-P-P$^1$-P-A-A-A$^2$-P-G$^1$-G$^1$ | 792 | 2.1-11 | 10 | 1 |
| 4867-31_477 | C$^1$-C-G-P-P-C$^1$-A-A-G$^1$-P-G-C$^1$-P-P-G$^1$-P-A$^1$-G-A-P-P$^1$-P-A-A$^2$-A$^2$-P-G$^1$-G$^1$ | 793 | 2.4E-11 | 10 | 2 |

TABLE 27-continued

Sequences of the VEGF aptamers created in order to enhance nuclease resistance. The binding dissociation constant ($K_d$ values) along with the number of 2'-OMe moieties (# OMe; superscript "1" indicates that the nucleotide has a 2'-O-methyl) and 3'-phosphorothioate linkages (# P=S; superscript "2" indicates that the nucleotide has a phosphorothioate linkage) are shown.

| Aptamer ID. No. | Sequence (5'→ 3') | SEQ ID NO. | $K_d$ (M) | # OMe | # P=S |
|---|---|---|---|---|---|
| 4867-31_478 | C-C-G-P-P-C$^1$-A-A-G$^1$-P-G-C$^1$-P-P-G$^1$-P-A$^1$-G$^1$-G-A-P-P$^1$-P-A-A$^2$-A$^2$-P-G$^1$-G$^1$ | 794 | 1.9E-11 | 9 | 2 |
| 4867-31_479 | C$^1$-C-G-P-P-C$^1$-A-A-G$^1$-P-G-C$^1$-P-P-G$^1$-P-A$^1$-G$^1$-G-A-P-P$^1$-P-A$^2$-A-A-P-G$^1$-G$^1$ | 795 | 2.6E-11 | 10 | 1 |
| 4867-31_480 | C$^1$-C-G-P-P-C$^1$-A-A-G$^1$-P-G-C$^1$-P-P-G$^1$-P-A$^1$-G$^1$-G-A-P-P$^1$-P-A$^2$-A$^2$-A-P-G$^1$-G$^1$ | 796 | 2.8E-11 | 10 | 2 |
| 4867-31_481 | C$^1$-C-G-P-P-C$^1$-A-A-G$^1$-P-G-C$^1$-P-P-G$^1$-P-A$^1$-G$^1$-G-A-P-P$^1$-P-A$^2$-A$^2$-A$^2$-P-G$^1$-G$^1$ | 797 | 2.6E-11 | 10 | 3 |
| 4867-31_482 | C-C-G-P-P-C$^1$-A-A-G$^1$-P-G-C$^1$-P-P-G$^1$-P-A$^1$-G$^1$-G-A-P-P$^1$-P-A$^2$-A$^2$-A$^2$-P-G$^1$-G$^1$ | 798 | 2.4E-11 | 9 | 3 |
| 4867-31_483 | C-C-G-P-P-C$^1$-A-A-G$^1$-P-G-C$^1$-P-P-G$^1$-P-A$^1$-G$^1$-G-A-P-P$^1$-P-A$^2$-A$^2$-A-P-G$^1$-G$^1$ | 799 | 3.2E-11 | 9 | 2 |

TABLE 28

A phosphorothioate walk along aptamers 5169-4_146.

| Aptamer ID. No. | Sequence (5'→ 3') | SEQ ID NO. | $K_d$ (M) | Ratio to parent |
|---|---|---|---|---|
| 5169-4_146 | C$^1$-G-A-C$^1$-A-G$^1$-C$^1$-A-P-G-P-A-P-G$^1$-C$^1$-A$^1$-C$^1$-A$^1$-P-C$^1$-P$^1$ | 545 | 1.5E-11 | 1.0 |
| 5169-4_150 | C$^1$-G$^2$-A-C$^1$-A-G$^1$-C$^1$-A-P-G-P-A-P-G$^1$-C$^1$-A$^1$-C$^1$-A$^1$-P-C$^1$-P$^1$ | 800 | 1.3E-11 | 0.89 |
| 5169-4_151 | C$^1$-G-A$^2$-C$^1$-A-G$^1$-C$^1$-A-P-G-P-A-P-G$^1$-C$^1$-A$^1$-C$^1$-A$^1$-P-C$^1$-P$^1$ | 801 | 6.0E-12 | 0.42 |
| 5169-4_152 | C$^1$-G-A-C$^1$-A$^2$-G$^1$-C$^1$-A-P-G-P-A-P-G$^1$-C$^1$-A$^1$-C$^1$-A$^1$-P-C$^1$-P$^1$ | 802 | 1.5E-11 | 1.0 |
| 5169-4_153 | C$^1$-G-A-C$^1$-A-G$^1$-C$^1$-A$^2$-P-G-P-A-P-G$^1$-C$^1$-A$^1$-C$^1$-A$^1$-P-C$^1$-P$^1$ | 803 | 1.3E-11 | 0.92 |
| 5169-4_154 | C$^1$-G-A-C$^1$-A-G$^1$-C$^1$-A-P$^2$-G-P-A-P-G$^1$-C$^1$-A$^1$-C$^1$-A$^1$-P-C$^1$-P$^1$ | 804 | 2.6E-11 | 1.8 |
| 5169-4_155 | C$^1$-G-A-C$^1$-A-G$^1$-C$^1$-A-P-G$^2$-P-A-P-G$^1$-C$^1$-A$^1$-C$^1$-A$^1$-P-C$^1$-P$^1$ | 805 | 6.9E-12 | 0.48 |
| 5169-4_156 | C$^1$-G-A-C$^1$-A-G$^1$-C$^1$-A-P-G-P$^2$-A-P-G$^1$-C$^1$-A$^1$-C$^1$-A$^1$-P-C$^1$-P$^1$ | 806 | 7.8E-12 | 0.54 |
| 5169-4_157 | C$^1$-G-A-C$^1$-A-G$^1$-C$^1$-A-P-G-P-A$^2$-P-G$^1$-C$^1$-A$^1$-C$^1$-A$^1$-P-C$^1$-P$^1$ | 807 | 1.8E-11 | 1.2 |
| 5169-4_158 | C$^1$-G-A-C$^1$-A-G$^1$-C$^1$-A-P-G-P-A-P$^2$-G$^1$-C$^1$-A$^1$-C$^1$-A$^1$-P-C$^1$-P$^1$ | 808 | 1.9E-11 | 1.3 |
| 5169-4_159 | C$^1$-G-A-C$^1$-A-G$^1$-C$^1$-A-P-G-P-A-P-G$^1$-C$^1$-A$^1$-C$^1$-A$^1$-P$^2$-C$^1$-P$^1$ | 809 | 1.5E-11 | 1.0 |
| 5169-4_172 | C$^{1,2}$-G-A-C$^1$-A-G$^1$-C$^1$-A-P-G-P-A-P-G$^1$-C$^1$-A$^1$-C$^1$-A$^1$-P-C$^1$-P$^1$ | 810 | 1.3E-11 | 0.90 |
| 5169-4_173 | C$^1$-G-A-C$^{1,2}$-A-G$^1$-C$^1$-A-P-G-P-A-P-G$^1$-C$^1$-A$^1$-C$^1$-A$^1$-P-C$^1$-P$^1$ | 811 | 9.1E-12 | 0.63 |
| 5169-4_174 | C$^1$-G-A-C$^1$-A-G$^1$-C$^{1,2}$-A-P-G-P-A-P-G$^1$-C$^1$-A$^1$-C$^1$-A$^1$-P-C$^1$-P$^1$ | 812 | 1.8E-11 | 1.2 |
| 5169-4_175 | C$^1$-G-A-C$^1$-A-G$^1$-C$^1$-A-P-G-P-A-P-G$^1$-C$^{1,2}$-A$^1$-C$^1$-A$^1$-P-C$^1$-P$^1$ | 813 | 6.9E-12 | 0.48 |
| 5169-4_176 | C$^1$-G-A-C$^1$-A-G$^1$-C$^1$-A-P-G-P-A-P-G$^1$-C$^1$-A$^1$-C$^{1,2}$-A$^1$-P-C$^1$-P$^1$ | 814 | 1.4E-11 | 0.93 |
| 5169-4_177 | C$^1$-G-A-C$^1$-A-G$^1$-C$^1$-A-P-G-P-A-P-G$^1$-C$^1$-A$^1$-C$^1$-A$^1$-P-C$^{1,2}$-P$^1$ | 815 | 7.2E-12 | 0.50 |
| 5169-4_178 | C$^1$-G-A-C$^1$-A-G$^{1,2}$-C$^1$-A-P-G-P-A-P-G$^1$-C$^1$-A$^1$-C$^1$-A$^1$-P-C$^1$-P$^1$ | 816 | 1.1E-11 | 0.76 |
| 5169-4_179 | C$^1$-G-A-C$^1$-A-G$^1$-C$^1$-A-P-G-P-A-P-G$^{1,2}$-C$^1$-A$^1$-C$^1$-A$^1$-P-C$^1$-P$^1$ | 817 | 7.7E-12 | 0.53 |

TABLE 28-continued

A phosphorothioate walk along aptamers 5169-4_146.

| Aptamer ID. No. | Sequence (5'→ 3') | SEQ ID NO. | $K_d$ (M) | Ratio to parent |
|---|---|---|---|---|
| 5169-4_180 | $C^1$-G-A-$C^1$-A-$G^1$-$C^1$-A-P-G-P-A-P-$G^1$-$C^1$-$A^{1,2}$-$C^1$-$A^1$-P-$C^1$-$P^1$ | 818 | 2.0E-11 | 1.4 |
| 5169-4_181 | $C^1$-G-A-$C^1$-A-$G^1$-$C^1$-A-P-G-P-A-P-$G^1$-$C^1$-$A^1$-$C^1$-$A^{1,2}$-P-$C^1$-$P^1$ | 819 | 2.1E-11 | 1.4 |

TABLE 29

Sequences of the PDGFBB aptamers created in order to enhance nuclease resistance. The binding dissociation constant ($K_d$ values) along with the number of 2'-OMe moieties (# OMe; superscript "1" indicates that the nucleotide has a 2'-O-methyl) and 3'-phosphorothioate linkages (# P=S; superscript "2" indicates that the nucleotide has a phosphorothioate linkage) are shown.

| Aptamer ID. No. | Sequence (5'→ 3') | SEQ ID NO. | Kd (M) | # OMe | # P=S |
|---|---|---|---|---|---|
| 5169-4_146 | $C^1$-G-A-$C^1$-A-$G^1$-$C^1$-A-P-G-P-A-P-$G^1$-$C^1$-$A^1$-$C^1$-$A^1$-P-$C^1$-$P^1$ | 545 | 2.6E-11 | 11 | 0 |
| 5169-4_182 | $C^1$-G-A-$C^1$-A-$G^1$-$C^1$-A-$P^2$-$G^2$-$P^2$-$A^2$-P-$G^1$-$C^1$-$A^1$-$C^1$-$A^1$-P-$C^1$-$P^1$ | 820 | 3.9E-11 | 11 | 4 |
| 5169-4_188 | $C^1$-G-A-$C^{1,2}$-A-$G^1$-$C^1$-A-$P^2$-$G^2$-$P^2$-$A^2$-P-$G^1$-$C^1$-$A^1$-$C^1$-$A^1$-P-$C^1$-$P^1$ | 821 | 8.6E-12* | 11 | 5 |

*Ki value as determined using competition binding assay as described in Example 14.

TABLE 30

Sequences of the PDGF aptamers created in order to enhance nuclease resistance. The binding dissociation constant ($K_d$ values) along with the number of 2'-OMe moieties (# OMe; superscript "1" indicates that the nucleotide has a 2'-O-methyl) and 3'-phosphorothioate linkages (# P=S; superscript "2" indicates that the nucleotide has a phosphorothioate linkage) are shown.

| Aptamer ID. No. | Sequence (5'→ 3') | SEQ ID NO. | $K_d$ (M) | # OMe | # P=S |
|---|---|---|---|---|---|
| 4149-8_379 | Bn-M-$A^1$-$C^1$-H-G-$Bn^1$-Bn-A-C-V-$C^1$-G-C-G-Bn-Bn-$Bn^1$-$A^1$-Bn-$A^1$-G-C-$G^1$ | 306 | 1.6E-11 | 7 | 0 |
| 4149-8_453 | Bn-Bn-$A^1$-C-H-G-$Bn^1$-Bn-$A^2$-C-V-$C^1$-$G^1$-C-$G^2$-$P^2$-$Bn^2$-$Bn^1$-$A^1$-Bn-$A^1$-G-C-$G^1$ | 822 | 2.0E-12 | 8 | 4 |
| 4149-8_454 | Bn-Bn-$A^1$-C-H-G-$Bn^1$-Bn-$A^2$-C-V-$C^1$-G-C-$G^2$-$P^2$-$Bn^2$-$Bn^1$-$A^1$-Bn-$A^1$-G-C-$G^1$ | 823 | 1.3E-12 | 7 | 4 |
| 4149-8_455 | Bn-Bn-$A^1$-C-H-G-$Bn^1$-$Bn^2$-$A^2$-C-V-$C^1$-$G^1$-C-$G^2$-$P^2$-$Bn^2$-$Bn^1$-$A^1$-Bn-$A^1$-G-C-$G^1$ | 824 | 1.7E-11 | 8 | 5 |
| 4149-8_456 | Bn-Bn-$A^1$-C-H-G-$Bn^1$-$Bn^2$-$A^2$-C-V-$C^1$-G-C-$G^2$-$P^2$-$Bn^2$-$Bn^1$-$A^1$-Bn-$A^1$-G-C-$G^1$ | 825 | 2.7E-11 | 7 | 5 |
| 4149-8_457 | Bn-Bn-$A^1$-$C^2$-H-G-$Bn^1$-$Bn^2$-$A^2$-$C^2$-V-$C^1$-$G^1$-C-$G^2$-$P^2$-$Bn^2$-$Bn^{1,2}$-$A^1$-Bn-$A^1$-G-C-$G^1$ | 826 | 4.3E-11* | 7 | 5 |
| 4149-8_458 | Bn-Bn-$A^1$-$C^2$-H-G-$Bn^1$-$Bn^2$-$A^2$-$C^2$-V-$C^1$-$G^1$-C-$G^2$-$G^2$-$P^2$-$Bn^2$-$Bn^{1,2}$-$A^1$-Bn-$A^1$-G-C-$G^1$ | 827 | 4.6E-11* | 8 | 8 |
| 4149-8_459 | Bn-Bn-$A^1$-$C^2$-H-G-$Bn^1$-$Bn^2$-$A^2$-$C^2$-V-$C^1$-$G^1$-C-$G^2$-$P^2$-$Bn^2$-$Bn^1$-$A^1$-Bn-$A^1$-G-C-$G^1$ | 828 | 1.3E-11* | 8 | 6 |

*Ki value as determined using competition binding assay as described in Example 14.

TABLE 31

Sequences of the PDGF aptamers created in order to enhance nuclease resistance.

| Aptamer ID. No. | Sequence (5'→ 3') | SEQ ID NO. | $K_d$ (M) |
|---|---|---|---|
| 4149-8_379 | Bn-M-A$^1$-C-H-G-Bn$^1$-Bn-A-C-V-C$^1$-G-C-G-Bn-Bn-Bn$^1$-A$^1$-Bn-A$^1$-G-C-G$^1$ | 306 | 5.2E-11 |
| 4149-8_391 | Bn-Bn-A$^1$-C-H-G-Bn-Bn-A$^2$-C-V-C$^1$-G-C-G$^2$-Bn-Bn-Bn$^1$-A$^1$-Bn-A$^1$-G-C-G$^1$ | 317 | 1.2E-11 |
| 4149-8_418 | Bn-M-A$^1$-C-H-G-Bn$^1$-Bn-A-C-V-C$^1$-G-C-G$^1$-Bn-Bn-Bn$^1$-A$^1$-Bn-A$^1$-G-C-G$^1$ | 330 | 2.1E-10 |
| 4149-8_419 | Bn-M-A$^1$-C-H-G-Bn$^1$-Bn-A-C-V-C$^1$-G-C-G$^1$-P-Bn-Bn$^1$-A$^1$-Bn-A$^1$-G-C-G$^1$ | 331 | 1.3E-9 |
| 4149-9_420 | Bn-M-A$^1$-C-H-G-Bn$^1$-Bn-A-C-V-C$^1$-G-C-G$^1$-i-Bn-Bn$^1$-A$^1$-Bn-A$^1$-G-C-G$^1$ | 829 | 1.4E-9 |
| 4149-8_421 | Bn-M-A$^1$-C-H-G-Bn$^1$-Bn-A-C-V-C$^1$-G$^1$-C-G-Bn-Bn-Bn$^1$-A$^1$-Bn-A$^1$-G-C-G$^1$ | 333 | 1.9E-11 |
| 4149-8_422 | Bn-M-A$^1$-C-H-G-Bn$^1$-Bn-A-C-V-C$^1$-G$^1$-C-G$^1$-Bn-Bn-Bn$^1$-A$^1$-Bn-A$^1$-G-C-G$^1$ | 334 | 2.7E-10 |
| 4149-8_423 | Bn-M-A$^1$-C-H-G-Bn$^1$-Bn-A-C-V-C$^1$-G$^1$-C-G-P-Bn-Bn$^1$-A$^1$-Bn-A$^1$-G-C-G$^1$ | 335 | 3.3E-11 |
| 4149-8_424 | Bn-M-A$^1$-C-H-G-Bn$^1$-Bn-A-C-V-C$^1$-G$^1$-C$^1$-G-Bn-Bn-Bn$^1$-A$^1$-Bn-A$^1$-G-C-G$^1$ | 336 | 6.6E-9 |
| 4149-8_425 | Bn-M-A$^1$-C-H-G-Bn$^1$-Bn-A$^1$-C-V-C$^1$-G-C-G-Bn-Bn-Bn$^1$-A$^1$-Bn-A$^1$-G-C-G$^1$ | 337 | 9.1E-10 |
| 4149-8_426 | Bn-M-A$^1$-C-H-G-Bn$^1$-Bn-A$^1$-C-V-C$^1$-G-C-G$^1$-Bn-Bn-Bn$^1$-A$^1$-Bn-A$^1$-G-C-G$^1$ | 409 | 4.2E-8 |
| 4149-8_431 | Bn-M-A$^1$-C-H-G-Bn$^1$-Bn-A$^2$-C-V-C$^1$-G-C-G$^2$-P-Bn$^2$-Bn$^1$-A$^1$-Bn-A$^1$-G-C-G$^1$ | 338 | 4.3E-11 |
| 4149-8_432 | Bn-M-A$^1$-C-H-G-Bn$^1$-Bn-A$^2$-C-V-C$^1$-G-C-G$^2$-Bn-Bn$^2$-Bn$^1$-A$^1$-Bn-A$^1$-G-C-G$^1$ | 339 | 2.9E-11 |
| 4149-8_433 | Bn-M-A$^1$-C-H-G-Bn$^1$-Bn-A$^2$-C-V-C$^1$-G-C-G$^2$-P-Bn-Bn$^1$-A$^1$-Bn-A$^1$-G-C-G$^1$ | 340 | 6.6E-11 |
| 4149-8_434 | Bn-M-A$^1$-C-H-G-Bn$^1$-Bn-A$^2$-C-V-C$^1$-G-C-G$^2$-Bn-Bn-Bn$^1$-A$^1$-Bn-A$^1$-G-C-G$^1$ | 341 | 3.2E-11 |
| 4149-8_435 | Bn-Bn-A$^1$-C-H-G-Bn$^1$-Bn-A$^2$-C-V-C$^1$-G-C-G$^2$-P-Bn$^2$-Bn$^1$-A$^1$-Bn-A$^1$-G-C-G$^1$ | 342 | 1.6E-11 |
| 4149-8_436 | Bn-Bn-A$^1$-C-H-G-Bn$^1$-Bn-A$^2$-C-V-C$^1$-G-C-G$^2$-Bn-Bn$^2$-Bn$^1$-A$^1$-Bn-A$^1$-G-C-G$^1$ | 343 | 7.7E-12 |
| 4149-8_437 | Bn-Bn-A$^1$-C-H-G-Bn$^1$-Bn-A$^2$-C-V-C$^1$-G-C-G$^2$-P-Bn-Bn$^1$-A$^1$-Bn-A$^1$-G-C-G$^1$ | 344 | 7.4E-12 |

SEQUENCE LISTING (846 sequences)

SEQ ID NO: 1 - DNA, 75 bp, Artificial Sequence
  Synthetic
  misc_feature (18)..(19): n is 5-(N-benzylcarboxyamide)-2'-deoxyuridine
  misc_feature (25)..(25): n is 5-(N-benzylcarboxyamide)-2'-deoxyuridine
  misc_feature (29)..(30): n is 5-(N-benzylcarboxyamide)-2'-deoxyuridine
  misc_feature (38)..(40): n is 5-(N-benzylcarboxyamide)-2'-deoxyuridine
  misc_feature (42)..(42): n is 5-(N-benzylcarboxyamide)-2'-deoxyuridine
  misc_feature (47)..(47): n is 5-(N-benzylcarboxyamide)-2'-deoxyuridine
  misc_feature (57)..(57): n is 5-(N-benzylcarboxyamide)-2'-deoxyuridine
cgccctcgtcccatctcnnacgacnacgnnacacgcgnnnanagcgncaacccgagngaacaccaaccgagaacg

SEQ ID NO: 2 - DNA, 50 bp, Artificial Sequence
  Synthetic
  misc_feature (6)..(7): n is 5-(N-benzylcarboxyamide)-2'-deoxyuridine
  misc_feature (13)..(13): n is 5-(N-benzylcarboxyamide)-2'-deoxyuridine
  misc_feature (17)..(18): n is 5-(N-benzylcarboxyamide)-2'-deoxyuridine
  misc_feature (26)..(28): n is 5-(N-benzylcarboxyamide)-2'-deoxyuridine
  misc_feature (30)..(30): n is 5-(N-benzylcarboxyamide)-2'-deoxyuridine
  misc_feature (35)..(35): n is 5-(N-benzylcarboxyamide)-2'-deoxyuridine
  misc_feature (45)..(45): n is 5-(N-benzylcarboxyamide)-2'-deoxyuridine
atctcnnacgacnacgnnacacgcgnnnanagcgncaacccgagngaaca

SEQ ID NO: 3 - DNA, 48 bp, Artificial Sequence
  Synthetic
  misc_feature (6)..(7): n is 5-(N-benzylcarboxyamide)-2'-deoxyuridine
  misc_feature (13)..(13): n is 5-(N-benzylcarboxyamide)-2'-deoxyuridine
  misc_feature (17)..(18): n is 5-(N-benzylcarboxyamide)-2'-deoxyuridine
  misc_feature (26)..(28): n is 5-(N-benzylcarboxyamide)-2'-deoxyuridine
  misc_feature (30)..(30): n is 5-(N-benzylcarboxyamide)-2'-deoxyuridine
  misc_feature (35)..(35): n is 5-(N-benzylcarboxyamide)-2'-deoxyuridine
  misc_feature (45)..(45): n is 5-(N-benzylcarboxyamide)-2'-deoxyuridine
atctcnnacgacnacgnnacacgcgnnnanagcgncaacccgagngaa

SEQ ID NO: 4 - DNA, 46 bp, Artificial Sequence
  Synthetic
  misc_feature (6)..(7): n is 5-(N-benzylcarboxyamide)-2'-deoxyuridine
  misc_feature (13)..(13): n is 5-(N-benzylcarboxyamide)-2'-deoxyuridine
  misc_feature (17)..(18): n is 5-(N-benzylcarboxyamide)-2'-deoxyuridine
  misc_feature (26)..(28): n is 5-(N-benzylcarboxyamide)-2'-deoxyuridine
  misc_feature (30)..(30): n is 5-(N-benzylcarboxyamide)-2'-deoxyuridine
  misc_feature (35)..(35): n is 5-(N-benzylcarboxyamide)-2'-deoxyuridine
  misc_feature (45)..(45): n is 5-(N-benzylcarboxyamide)-2'-deoxyuridine
atctcnnacgacnacgnnacacgcgnnnanagcgncaacccgagng

SEQ ID NO: 5 - DNA, 44 bp, Artificial Sequence
  Synthetic
  misc_feature (6)..(7): n is 5-(N-benzylcarboxyamide)-2'-deoxyuridine
  misc_feature (13)..(13): n is 5-(N-benzylcarboxyamide)-2'-deoxyuridine
  misc_feature (17)..(18): n is 5-(N-benzylcarboxyamide)-2'-deoxyuridine
  misc_feature (26)..(28): n is 5-(N-benzylcarboxyamide)-2'-deoxyuridine
  misc_feature (30)..(30): n is 5-(N-benzylcarboxyamide)-2'-deoxyuridine
  misc_feature (35)..(35): n is 5-(N-benzylcarboxyamide)-2'-deoxyuridine
atctcnnacgacnacgnnacacgcgnnnanagcgncaacccgag

SEQ ID NO: 6 - DNA, 42 bp, Artificial Sequence
  Synthetic
  misc_feature (6)..(7): n is 5-(N-benzylcarboxyamide)-2'-deoxyuridine
  misc_feature (13)..(13): n is 5-(N-benzylcarboxyamide)-2'-deoxyuridine
  misc_feature (17)..(18): n is 5-(N-benzylcarboxyamide)-2'-deoxyuridine
  misc_feature (26)..(28): n is 5-(N-benzylcarboxyamide)-2'-deoxyuridine
  misc_feature (30)..(30): n is 5-(N-benzylcarboxyamide)-2'-deoxyuridine
  misc_feature (35)..(35): n is 5-(N-benzylcarboxyamide)-2'-deoxyuridine
atctcnnacgacnacgnnacacgcgnnnanagcgncaacccg

SEQ ID NO: 7 - DNA, 40 bp, Artificial Sequence
  Synthetic
  misc_feature (6)..(7): n is 5-(N-benzylcarboxyamide)-2'-deoxyuridine
  misc_feature (13)..(13): n is 5-(N-benzylcarboxyamide)-2'-deoxyuridine
  misc_feature (17)..(18): n is 5-(N-benzylcarboxyamide)-2'-deoxyuridine
  misc_feature (26)..(28): n is 5-(N-benzylcarboxyamide)-2'-deoxyuridine
  misc_feature (30)..(30): n is 5-(N-benzylcarboxyamide)-2'-deoxyuridine
  misc_feature (35)..(35): n is 5-(N-benzylcarboxyamide)-2'-deoxyuridine
atctcnnacgacnacgnnacacgcgnnnanagcgncaacc

SEQ ID NO: 8 - DNA, 38 bp, Artificial Sequence
  Synthetic
  misc_feature (6)..(7): n is 5-(N-benzylcarboxyamide)-2'-deoxyuridine
  misc_feature (13)..(13): n is 5-(N-benzylcarboxyamide)-2'-deoxyuridine
  misc_feature (17)..(18): n is 5-(N-benzylcarboxyamide)-2'-deoxyuridine
  misc_feature (26)..(28): n is 5-(N-benzylcarboxyamide)-2'-deoxyuridine
  misc_feature (30)..(30): n is 5-(N-benzylcarboxyamide)-2'-deoxyuridine
  misc_feature (35)..(35): n is 5-(N-benzylcarboxyamide)-2'-deoxyuridine
atctcnnacgacnacgnnacacgcgnnnanagcgncaa

SEQ ID NO: 9 - DNA, 36 bp, Artificial Sequence
  Synthetic
  misc_feature (6)..(7): n is 5-(N-benzylcarboxyamide)-2'-deoxyuridine
  misc_feature (13)..(13): n is 5-(N-benzylcarboxyamide)-2'-deoxyuridine
  misc_feature (17)..(18): n is 5-(N-benzylcarboxyamide)-2'-deoxyuridine
  misc_feature (26)..(28): n is 5-(N-benzylcarboxyamide)-2'-deoxyuridine
  misc_feature (30)..(30): n is 5-(N-benzylcarboxyamide)-2'-deoxyuridine
  misc_feature (35)..(35): n is 5-(N-benzylcarboxyamide)-2'-deoxyuridine
atctcnnacgacnacgnnacacgcgnnnanagcgnc

SEQ ID NO: 10 - DNA, 48 bp, Artificial Sequence
  Synthetic
  misc_feature (4)..(5): n is 5-(N-benzylcarboxyamide)-2'-deoxyuridine
  misc_feature (11)..(11): n is 5-(N-benzylcarboxyamide)-2'-deoxyuridine
  misc_feature (15)..(16): n is 5-(N-benzylcarboxyamide)-2'-deoxyuridine
  misc_feature (24)..(26): n is 5-(N-benzylcarboxyamide)-2'-deoxyuridine
  misc_feature (28)..(28): n is 5-(N-benzylcarboxyamide)-2'-deoxyuridine
  misc_feature (33)..(33): n is 5-(N-benzylcarboxyamide)-2'-deoxyuridine
  misc_feature (43)..(43): n is 5-(N-benzylcarboxyamide)-2'-deoxyuridine
ctcnnacgacnacgnnacacgcgnnnanagcgncaacccgagngaaca

SEQ ID NO: 11 - DNA, 46 bp, Artificial Sequence
  Synthetic
  misc_feature (2)..(3): n is 5-(N-benzylcarboxyamide)-2'-deoxyuridine
  misc_feature (9)..(9): n is 5-(N-benzylcarboxyamide)-2'-deoxyuridine
  misc_feature (13)..(14): n is 5-(N-benzylcarboxyamide)-2'-deoxyuridine
  misc_feature (22)..(24): n is 5-(N-benzylcarboxyamide)-2'-deoxyuridine
  misc_feature (26)..(26): n is 5-(N-benzylcarboxyamide)-2'-deoxyuridine
  misc_feature (31)..(31): n is 5-(N-benzylcarboxyamide)-2'-deoxyuridine
  misc_feature (41)..(41): n is 5-(N-benzylcarboxyamide)-2'-deoxyuridine
cnnacgacnacgnnacacgcgnnnanagcgncaacccgagngaaca

SEQ ID NO: 12 - DNA, 44 bp, Artificial Sequence
  Synthetic
  misc_feature (1)..(1): n is 5-(N-benzylcarboxyamide)-2'-deoxyuridine
  misc_feature (7)..(7): n is 5-(N-benzylcarboxyamide)-2'-deoxyuridine
  misc_feature (11)..(12): n is 5-(N-benzylcarboxyamide)-2'-deoxyuridine
  misc_feature (20)..(22): n is 5-(N-benzylcarboxyamide)-2'-deoxyuridine
  misc_feature (24)..(24): n is 5-(N-benzylcarboxyamide)-2'-deoxyuridine
  misc_feature (29)..(29): n is 5-(N-benzylcarboxyamide)-2'-deoxyuridine
  misc_feature (39)..(39): n is 5-(N-benzylcarboxyamide)-2'-deoxyuridine
nacgacnacgnnacacgcgnnnanagcgncaacccgagngaaca

SEQ ID NO: 13 - DNA, 45 bp, Artificial Sequence
  Synthetic
  misc_feature (2)..(3): n is 5-(N-benzylcarboxyamide)-2'-deoxyuridine
  misc_feature (9)..(9): n is 5-(N-benzylcarboxyamide)-2'-deoxyuridine
  misc_feature (13)..(14): n is 5-(N-benzylcarboxyamide)-2'-deoxyuridine
  misc_feature (22)..(24): n is 5-(N-benzylcarboxyamide)-2'-deoxyuridine
  misc_feature (26)..(26): n is 5-(N-benzylcarboxyamide)-2'-deoxyuridine
  misc_feature (31)..(31): n is 5-(N-benzylcarboxyamide)-2'-deoxyuridine
  misc_feature (41)..(41): n is 5-(N-benzylcarboxyamide)-2'-deoxyuridine
cnnacgacnacgnnacacgcgnnnanagcgncaacccgagngaac

SEQ ID NO: 14 - DNA, 44 bp, Artificial Sequence
  Synthetic
  misc_feature (2)..(3): n is 5-(N-benzylcarboxyamide)-2'-deoxyuridine
  misc_feature (9)..(9): n is 5-(N-benzylcarboxyamide)-2'-deoxyuridine
  misc_feature (13)..(14): n is 5-(N-benzylcarboxyamide)-2'-deoxyuridine
  misc_feature (22)..(24): n is 5-(N-benzylcarboxyamide)-2'-deoxyuridine
  misc_feature (26)..(26): n is 5-(N-benzylcarboxyamide)-2'-deoxyuridine
  misc_feature (31)..(31): n is 5-(N-benzylcarboxyamide)-2'-deoxyuridine
  misc_feature (41)..(41): n is 5-(N-benzylcarboxyamide)-2'-deoxyuridine
cnnacgacnacgnnacacgcgnnnanagcgncaacccgagngaa

SEQ ID NO: 15 - DNA, 43 bp, Artificial Sequence
  Synthetic
  misc_feature (2)..(3): n is 5-(N-benzylcarboxyamide)-2'-deoxyuridine
  misc_feature (9)..(9): n is 5-(N-benzylcarboxyamide)-2'-deoxyuridine
  misc_feature (13)..(14): n is 5-(N-benzylcarboxyamide)-2'-deoxyuridine
  misc_feature (22)..(24): n is 5-(N-benzylcarboxyamide)-2'-deoxyuridine
  misc_feature (26)..(26): n is 5-(N-benzylcarboxyamide)-2'-deoxyuridine
  misc_feature (31)..(31): n is 5-(N-benzylcarboxyamide)-2'-deoxyuridine
  misc_feature (41)..(41): n is 5-(N-benzylcarboxyamide)-2'-deoxyuridine
cnnacgacnacgnnacacgcgnnnanagcgncaacccgagnga

SEQ ID NO: 16 - DNA, 42 bp, Artificial Sequence
  Synthetic
  misc_feature (2)..(3): n is 5-(N-benzylcarboxyamide)-2'-deoxyuridine
  misc_feature (9)..(9): n is 5-(N-benzylcarboxyamide)-2'-deoxyuridine
  misc_feature (13)..(14): n is 5-(N-benzylcarboxyamide)-2'-deoxyuridine
  misc_feature (22)..(24): n is 5-(N-benzylcarboxyamide)-2'-deoxyuridine
  misc_feature (26)..(26): n is 5-(N-benzylcarboxyamide)-2'-deoxyuridine
  misc_feature (31)..(31): n is 5-(N-benzylcarboxyamide)-2'-deoxyuridine
  misc_feature (41)..(41): n is 5-(N-benzylcarboxyamide)-2'-deoxyuridine
cnnacgacnacgnnacacgcgnnnanagcgncaacccgagng

SEQ ID NO: 17 - DNA, 41 bp, Artificial Sequence
  Synthetic
  misc_feature (2)..(3): n is 5-(N-benzylcarboxyamide)-2'-deoxyuridine
  misc_feature (9)..(9): n is 5-(N-benzylcarboxyamide)-2'-deoxyuridine
  misc_feature (13)..(14): n is 5-(N-benzylcarboxyamide)-2'-deoxyuridine
  misc_feature (22)..(24): n is 5-(N-benzylcarboxyamide)-2'-deoxyuridine
  misc_feature (26)..(26): n is 5-(N-benzylcarboxyamide)-2'-deoxyuridine
  misc_feature (31)..(31): n is 5-(N-benzylcarboxyamide)-2'-deoxyuridine
cnnacgacnacgnnacacgcgnnnanagcgncaacccgagt

SEQ ID NO: 18 - DNA, 40 bp, Artificial Sequence
  Synthetic
  misc_feature (2)..(3): n is 5-(N-benzylcarboxyamide)-2'-deoxyuridine
  misc_feature (9)..(9): n is 5-(N-benzylcarboxyamide)-2'-deoxyuridine
  misc_feature (13)..(14): n is 5-(N-benzylcarboxyamide)-2'-deoxyuridine
  misc_feature (22)..(24): n is 5-(N-benzylcarboxyamide)-2'-deoxyuridine
  misc_feature (26)..(26): n is 5-(N-benzylcarboxyamide)-2'-deoxyuridine
  misc_feature (31)..(31): n is 5-(N-benzylcarboxyamide)-2'-deoxyuridine
cnnacgacnacgnnacacgcgnnnanagcgncaacccgag

SEQ ID NO: 19 - DNA, 39 bp, Artificial Sequence
  Synthetic
  misc_feature (2)..(3): n is 5-(N-benzylcarboxyamide)-2'-deoxyuridine
  misc_feature (9)..(9): n is 5-(N-benzylcarboxyamide)-2'-deoxyuridine
  misc_feature (13)..(14): n is 5-(N-benzylcarboxyamide)-2'-deoxyuridine
  misc_feature (22)..(24): n is 5-(N-benzylcarboxyamide)-2'-deoxyuridine
  misc_feature (26)..(26): n is 5-(N-benzylcarboxyamide)-2'-deoxyuridine
  misc_feature (31)..(31): n is 5-(N-benzylcarboxyamide)-2'-deoxyuridine
cnnacgacnacgnnacacgcgnnnanagcgncaacccga

SEQ ID NO: 20 - DNA, 34 bp, Artificial Sequence
  Synthetic
  misc_feature (4)..(5): n is 5-(N-benzylcarboxyamide)-2'-deoxyuridine
  misc_feature (11)..(11): n is 5-(N-benzylcarboxyamide)-2'-deoxyuridine
  misc_feature (15)..(16): n is 5-(N-benzylcarboxyamide)-2'-deoxyuridine
  misc_feature (24)..(26): n is 5-(N-benzylcarboxyamide)-2'-deoxyuridine
  misc_feature (28)..(28): n is 5-(N-benzylcarboxyamide)-2'-deoxyuridine
  misc_feature (33)..(33): n is 5-(N-benzylcarboxyamide)-2'-deoxyuridine
ctcnnacgacnacgnnacacgcgnnnanagcgnc

SEQ ID NO: 21 - DNA, 32 bp, Artificial Sequence
  Synthetic
  misc_feature (2)..(3): n is 5-(N-benzylcarboxyamide)-2'-deoxyuridine
  misc_feature (9)..(9): n is 5-(N-benzylcarboxyamide)-2'-deoxyuridine
  misc_feature (13)..(14): n is 5-(N-benzylcarboxyamide)-2'-deoxyuridine
  misc_feature (22)..(24): n is 5-(N-benzylcarboxyamide)-2'-deoxyuridine
  misc_feature (26)..(26): n is 5-(N-benzylcarboxyamide)-2'-deoxyuridine
  misc_feature (31)..(31): n is 5-(N-benzylcarboxyamide)-2'-deoxyuridine
cnnacgacnacgnnacacgcgnnnanagcgnc

SEQ ID NO: 22 - DNA, 31 bp, Artificial Sequence
  Synthetic
  misc_feature (2)..(3): n is 5-(N-benzylcarboxyamide)-2'-deoxyuridine
  misc_feature (9)..(9): n is 5-(N-benzylcarboxyamide)-2'-deoxyuridine
  misc_feature (13)..(14): n is 5-(N-benzylcarboxyamide)-2'-deoxyuridine
  misc_feature (22)..(24): n is 5-(N-benzylcarboxyamide)-2'-deoxyuridine
  misc_feature (26)..(26): n is 5-(N-benzylcarboxyamide)-2'-deoxyuridine
cnnacgacnacgnnacacgcgnnnanagcgt

SEQ ID NO: 23 - DNA, 30 bp, Artificial Sequence
  Synthetic
  misc_feature (2)..(3): n is 5-(N-benzylcarboxyamide)-2'-deoxyuridine
  misc_feature (9)..(9): n is 5-(N-benzylcarboxyamide)-2'-deoxyuridine
  misc_feature (13)..(14): n is 5-(N-benzylcarboxyamide)-2'-deoxyuridine
  misc_feature (22)..(24): n is 5-(N-benzylcarboxyamide)-2'-deoxyuridine
  misc_feature (26)..(26): n is 5-(N-benzylcarboxyamide)-2'-deoxyuridine
cnnacgacnacgnnacacgcgnnnanagcg

SEQ ID NO: 24 - DNA, 29 bp, Artificial Sequence
  Synthetic
  misc_feature (2)..(3): n is 5-(N-benzylcarboxyamide)-2'-deoxyuridine
  misc_feature (9)..(9): n is 5-(N-benzylcarboxyamide)-2'-deoxyuridine
  misc_feature (13)..(14): n is 5-(N-benzylcarboxyamide)-2'-deoxyuridine
  misc_feature (22)..(24): n is 5-(N-benzylcarboxyamide)-2'-deoxyuridine
  misc_feature (26)..(26): n is 5-(N-benzylcarboxyamide)-2'-deoxyuridine
cnnacgacnacgnnacacgcgnnnanagc

SEQ ID NO: 25 - DNA, 28 bp, Artificial Sequence
  Synthetic
  misc_feature (2)..(3): n is 5-(N-benzylcarboxyamide)-2'-deoxyuridine
  misc_feature (9)..(9): n is 5-(N-benzylcarboxyamide)-2'-deoxyuridine
  misc_feature (13)..(14): n is 5-(N-benzylcarboxyamide)-2'-deoxyuridine
  misc_feature (22)..(24): n is 5-(N-benzylcarboxyamide)-2'-deoxyuridine
  misc_feature (26)..(26): n is 5-(N-benzylcarboxyamide)-2'-deoxyuridine
cnnacgacnacgnnacacgcgnnnanag

SEQ ID NO: 26 - DNA, 31 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
  misc_feature (30)..(30): n is 5-(N-benzylcarboxyamide)-2'-deoxyuridine
nnacgacnacgnnacacgcgnnnanagcgnc

SEQ ID NO: 27 - DNA, 30 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcgt

SEQ ID NO: 28 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 29 - DNA, 28 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagc

SEQ ID NO: 30 - DNA, 27 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanag

SEQ ID NO: 31 - DNA, 29 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnncgacnacgnnacacgcgnnnanagcg

SEQ ID NO: 32 - DNA, 29 bp, Artificial Sequence
  Synthetic
  misc_feature (1)..(2): n is 5-(N-benzylcarboxyamide)-2'-deoxyuridine
  misc_feature (4)..(4): n is 2'-O-methyl-cytidine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnangacnacgnnacacgcgnnnanagcg

SEQ ID NO: 33 - DNA, 29 bp, Artificial Sequence
  Synthetic
  misc_feature (1)..(2): n is 5-(N-benzylcarboxyamide)-2'-deoxyuridine
  misc_feature (5)..(5): n is 2'-O-methyl-guanosine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacnacnacgnnacacgcgnnnanagcg

SEQ ID NO: 34 - DNA, 29 bp, Artificial Sequence
  Synthetic
  misc_feature (1)..(2): n is 5-(N-benzylcarboxyamide)-2'-deoxyuridine
  misc_feature (6)..(6): n is 2'-O-methyl-adenosine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgncnacgnnacacgcgnnnanagcg

SEQ ID NO: 35 - DNA, 29 bp, Artificial Sequence
  Synthetic
  misc_feature (1)..(2): n is 5-(N-benzylcarboxyamide)-2'-deoxyuridine
  misc_feature (7)..(7): n is 2'-O-methyl-cytidine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgannacgnnacacgcgnnnanagcg

SEQ ID NO: 36 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (9)..(9): n is 2'-O-methyl-adenosine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnncgnnacacgcgnnnanagcg

SEQ ID NO: 37 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (10)..(10): n is 2'-O-methyl-cytidine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnangnnacacgcgnnnanagcg

SEQ ID NO: 38 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (11)..(11): n is 2'-O-methyl-guanosine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacnnnacacgcgnnnanagcg

SEQ ID NO: 39 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (14)..(14): n is 2'-O-methyl-adenosine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnncacgcgnnnanagcg

SEQ ID NO: 40 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (15)..(15): n is 2'-O-methyl-cytidine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnanacgcgnnnanagcg

SEQ ID NO: 41 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (16)..(16): n is 2'-O-methyl-adenosine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacncgcgnnnanagcg

SEQ ID NO: 42 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (17)..(17): n is 2'-O-methyl-cytidine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacangcgnnnanagcg

SEQ ID NO: 43 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (18)..(18): n is 2'-O-methyl-guanosine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacncgnnnanagcg

SEQ ID NO: 44 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (19)..(19): n is 2'-O-methyl-cytidine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgngnnnanagcg

SEQ ID NO: 45 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (20)..(20): n is 2'-O-methyl-guanosine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcnnnnanagcg

SEQ ID NO: 46 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (24)..(24): n is 2'-O-methyl-adenosine
  misc_feature (25)..(25): n is 5-(N-benzylcarboxyamide)-2'-deoxyuridine
nnacgacnacgnnacacgcgnnnnnagcg

SEQ ID NO: 47 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
  misc_feature (26)..(26): n is 2'-O-methyl-adenosine
nnacgacnacgnnacacgcgnnnanngcg

SEQ ID NO: 48 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
  misc_feature (27)..(27): n is 2'-O-methyl-guanosine
nnacgacnacgnnacacgcgnnnanancg

SEQ ID NO: 49 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
  misc_feature (28)..(28): n is 2'-O-methyl-cytidine
nnacgacnacgnnacacgcgnnnanagng

SEQ ID NO: 50 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
  misc_feature (29)..(29): n is 2'-O-methyl-guanosine
nnacgacnacgnnacacgcgnnnanagcn

SEQ ID NO: 51 - DNA, 29 bp, Artificial Sequence
  Synthetic
  misc_feature (1)..(1): n is 1,3-propane diol
  misc_feature (2)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 52 - DNA, 29 bp, Artificial Sequence
  Synthetic
  misc_feature (1)..(2): n is 5-(N-benzylcarboxyamide)-2'-deoxyuridine
  misc_feature (4)..(4): n is 1,3-propane diol
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnangacnacgnnacacgcgnnnanagcg

SEQ ID NO: 53 - DNA, 29 bp, Artificial Sequence
  Synthetic
  misc_feature (1)..(2): n is 5-(N-benzylcarboxyamide)-2'-deoxyuridine
  misc_feature (5)..(5): n is 1,3-propane diol
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacnacnacgnnacacgcgnnnanagcg

SEQ ID NO: 54 - DNA, 29 bp, Artificial Sequence
  Synthetic
  misc_feature (1)..(2): n is 5-(N-benzylcarboxyamide)-2'-deoxyuridine
  misc_feature (6)..(6): n is 1,3-propane diol
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgncnacgnnacacgcgnnnanagcg

SEQ ID NO: 55 - DNA, 29 bp, Artificial Sequence
  Synthetic
  misc_feature (1)..(2): n is 5-(N-benzylcarboxyamide)-2'-deoxyuridine
  misc_feature (7)..(7): n is 1,3-propane diol
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgannacgnnacacgcgnnnanagcg

SEQ ID NO: 56 - DNA, 29 bp, Artificial Sequence
  Synthetic
  misc_feature (1)..(2): n is 5-(N-benzylcarboxyamide)-2'-deoxyuridine
  misc_feature (8)..(8): n is 1,3-propane diol
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 57 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (9)..(9): n is 1,3-propane diol
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnncgnnacacgcgnnnanagcg

SEQ ID NO: 58 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (10)..(10): n is 1,3-propane diol
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnangnnacacgcgnnnanagcg

SEQ ID NO: 59 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (15)..(15): n is 1,3-propane diol
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnanacgcgnnnanagcg

SEQ ID NO: 60 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (16)..(16): n is 1,3-propane diol
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacncgcgnnnanagcg

SEQ ID NO: 61 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (17)..(17): n is 1,3-propane diol
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacangcgnnnanagcg

SEQ ID NO: 62 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (24)..(24): n is 1,3-propane diol
  misc_feature (25)..(25): n is 5-(N-benzylcarboxyamide)-2'-deoxyuridine
nnacgacnacgnnacacgcgnnnnnagcg

SEQ ID NO: 63 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
  misc_feature (28)..(28): n is 1,3-propane diol
nnacgacnacgnnacacgcgnnnanagng

SEQ ID NO: 64 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
  misc_feature (29)..(29): n is 1,3-propane diol
nnacgacnacgnnacacgcgnnnanagcn

SEQ ID NO: 65 - DNA, 29 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (6)..(6): n is 2'-O-methyl-adenosine
  misc_feature (8)..(8): n is 5-(N-benzylcarboxyamide)-2'-deoxyuridine
  misc_feature (9)..(9): n is 2'-O-methyl-adenosine
  misc_feature (12)..(13): n is 5-(N-benzylcarboxyamide)-2'-deoxyuridine
  misc_feature (16)..(16): n is 2'-O-methyl-adenosine
  misc_feature (18)..(18): n is 2'-O-methyl-guanosine
  misc_feature (21)..(23): n is 5-(N-benzylcarboxyamide)-2'-deoxyuridine
  misc_feature (24)..(24): n is 2'-O-methyl-adenosine
  misc_feature (25)..(25): n is 5-(N-benzylcarboxyamide)-2'-deoxyuridine
  misc_feature (26)..(26): n is 2'-O-methyl-adenosine
  misc_feature (27)..(27): n is 2'-O-methyl-guanosine
  misc_feature (28)..(28): n is 2'-O-methyl-cytidine
  misc_feature (29)..(29): n is 2'-O-methyl-guanosine
nnncgncnncgnnacncncgnnnnnnnnn

SEQ ID NO: 66 - DNA, 29 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (8)..(8): n is 5-(N-benzylcarboxyamide)-2'-deoxyuridine
  misc_feature (9)..(9): n is 2'-O-methyl-adenosine
  misc_feature (12)..(13): n is 5-(N-benzylcarboxyamide)-2'-deoxyuridine
  misc_feature (16)..(16): n is 2'-O-methyl-adenosine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
  misc_feature (26)..(26): n is 2'-O-methyl-adenosine
  misc_feature (29)..(29): n is 2'-O-methyl-guanosine
nnncgacnncgnnacncgcgnnnanngcn

SEQ ID NO: 67 - DNA, 24 bp, Artificial Sequence
  Synthetic
  misc_feature (1)..(2): n is 5-(N-benzylcarboxyamide)-2'-deoxyuridine
  misc_feature (5)..(5): n is hexaethylene glycol
  misc_feature (7)..(8): n is 5-(N-benzylcarboxyamide)-2'-deoxyuridine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
nnacngnnacacgcgnnnanagcg

SEQ ID NO: 68 - DNA, 25 bp, Artificial Sequence
  Synthetic
  misc_feature (1)..(2): n is 5-(N-benzylcarboxyamide)-2'-deoxyuridine
  misc_feature (5)..(6): n is hexaethylene glycol
  misc_feature (8)..(9): n is 5-(N-benzylcarboxyamide)-2'-deoxyuridine
  misc_feature (17)..(19): n is 5-(N-benzylcarboxyamide)-2'-deoxyuridine
  misc_feature (21)..(21): n is 5-(N-benzylcarboxyamide)-2'-deoxyuridine
nnacnngnnacacgcgnnnanagcg

SEQ ID NO: 69 - DNA, 26 bp, Artificial Sequence
  Synthetic
  misc_feature (1)..(2): n is 5-(N-benzylcarboxyamide)-2'-deoxyuridine
  misc_feature (6)..(6): n is hexaethylene glycol
  misc_feature (9)..(10): n is 5-(N-benzylcarboxyamide)-2'-deoxyuridine
  misc_feature (18)..(20): n is 5-(N-benzylcarboxyamide)-2'-deoxyuridine
  misc_feature (22)..(22): n is 5-(N-benzylcarboxyamide)-2'-deoxyuridine
nnacgncgnnacacgcgnnnanagcg

SEQ ID NO: 70 - DNA, 29 bp, Artificial Sequence
  Synthetic
  misc_feature (1)..(2): n is 5-(N-benzylcarboxyamide)-2'-deoxyuridine
  misc_feature (5)..(10): n is 1,3-propane diol
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacnnnnnngnnacacgcgnnnanagcg

SEQ ID NO: 71 - DNA, 27 bp, Artificial Sequence
  Synthetic
  misc_feature (1)..(2): n is 5-(N-benzylcarboxyamide)-2'-deoxyuridine
  misc_feature (5)..(8): n is 1,3-propane diol
  misc_feature (10)..(11): n is 5-(N-benzylcarboxyamide)-2'-deoxyuridine
  misc_feature (19)..(21): n is 5-(N-benzylcarboxyamide)-2'-deoxyuridine
  misc_feature (23)..(23): n is 5-(N-benzylcarboxyamide)-2'-deoxyuridine
nnacnnnngnnacacgcgnnnanagcg

SEQ ID NO: 72 - DNA, 25 bp, Artificial Sequence
  Synthetic
  misc_feature (1)..(2): n is 5-(N-benzylcarboxyamide)-2'-deoxyuridine
  misc_feature (5)..(6): n is 1,3-propane diol
  misc_feature (8)..(9): n is 5-(N-benzylcarboxyamide)-2'-deoxyuridine
  misc_feature (17)..(19): n is 5-(N-benzylcarboxyamide)-2'-deoxyuridine
  misc_feature (21)..(21): n is 5-(N-benzylcarboxyamide)-2'-deoxyuridine
nnacnngnnacacgcgnnnanagcg

SEQ ID NO: 73 - DNA, 29 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (6)..(6): n is 1,3-propane diol
  misc_feature (8)..(9): n is 1,3-propane diol
  misc_feature (12)..(13): n is 5-(N-benzylcarboxyamide)-2'-deoxyuridine
  misc_feature (16)..(16): n is 2'-O-methyl-adenosine
  misc_feature (18)..(18): n is 2'-O-methyl-guanosine
  misc_feature (21)..(23): n is 5-(N-benzylcarboxyamide)-2'-deoxyuridine
  misc_feature (24)..(24): n is 2'-O-methyl-adenosine
  misc_feature (25)..(25): n is 5-(N-benzylcarboxyamide)-2'-deoxyuridine
  misc_feature (26)..(26): n is 2'-O-methyl-adenosine
  misc_feature (27)..(27): n is 2'-O-methyl-guanosine
  misc_feature (28)..(28): n is 2'-O-methyl-cytidine
  misc_feature (29)..(29): n is 2'-O-methyl-guanosine
nnncgncnncgnnacncncgnnnnnnnnn

SEQ ID NO: 74 - DNA, 29 bp, Artificial Sequence
  Synthetic
  misc_feature (1)..(1): n is 2'-O-methyl-uridine
  misc_feature (2)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 75 - DNA, 29 bp, Artificial Sequence
  Synthetic
  misc_feature (1)..(2): n is 5-(N-benzylcarboxyamide)-2'-deoxyuridine
  misc_feature (8)..(8): n is 2'-O-methyl-uridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 76 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(12): n is 2'-O-methyl-uridine
  misc_feature (13)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 77 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(22): n is 5-(N-benzylcarboxyamide)-2'-deoxyuridine
  misc_feature (23)..(23): n is 2'-O-methyl-uridine
  misc_feature (25)..(25): n is 5-(N-benzylcarboxyamide)-2'-deoxyuridine
nnacgacnacgnnacacgcgnnnanagcg

SEQ ID NO: 78 - DNA, 29 bp, Artificial Sequence
  Synthetic
  misc_feature (1)..(1): n is 5-(N-benzylcarboxyamide)-2'-deoxyuridine
  misc_feature (2)..(2): n is 5-[N-(1-naphthylmethyl)carboxyamide]-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 79 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-[N-(1-naphthylmethyl)carboxyamide]-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 80 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(12): n is 5-[N-(1-naphthylmethyl)carboxyamide]-2'-deoxyuridine
  misc_feature (13)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 81 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(12): n is 5-(N-benzylcarboxyamide)-2'-deoxyuridine
  misc_feature (13)..(13): n is 5-[N-(1-naphthylmethyl)carboxyamide]-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 82 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(21): n is 5-[N-(1-naphthylmethyl)carboxyamide]-2'-deoxyuridine
  misc_feature (22)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 83 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(21): n is 5-(N-benzylcarboxyamide)-2'-deoxyuridine
  misc_feature (22)..(22): n is 5-[N-(1-naphthylmethyl)carboxyamide]-2'-deoxyuridine
  misc_feature (23)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 84 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(22): n is 5-(N-benzylcarboxyamide)-2'-deoxyuridine
  misc_feature (23)..(23): n is 5-[N-(1-naphthylmethyl)carboxyamide]-2'-deoxyuridine
  misc_feature (25)..(25): n is 5-(N-benzylcarboxyamide)-2'-deoxyuridine
nnacgacnacgnnacacgcgnnnanagcg

SEQ ID NO: 85 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-[N-(1-naphthylmethyl)carboxyamide]-2'-deoxyuridine
nnacgacnacgnnacacgcgnnnanagcg

SEQ ID NO: 86 - DNA, 29 bp, Artificial Sequence
  Synthetic
  misc_feature (1)..(1): n is 5-[N-(1-naphthylmethyl)carboxyamide]-2'-deoxyuridine
  misc_feature (2)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 87 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 2'-O-methyl-uridine
nnacgacnacgnnacacgcgnnnanagcg

SEQ ID NO: 88 - DNA, 25 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(6): n is hexaethylene glycol
  misc_feature (8)..(9): n is 5-(N-benzylcarboxyamide)-2'-deoxyuridine
  misc_feature (12)..(12): n is 2'-O-methyl-adenosine
  misc_feature (17)..(19): n is 5-(N-benzylcarboxyamide)-2'-deoxyuridine
  misc_feature (21)..(21): n is 5-(N-benzylcarboxyamide)-2'-deoxyuridine
  misc_feature (22)..(22): n is 2'-O-methyl-adenosine
  misc_feature (25)..(25): n is 2'-O-methyl-guanosine
nnncnngnnacncgcgnnnanngcn

SEQ ID NO: 89 - DNA, 25 bp, Artificial Sequence
  Synthetic
  misc_feature (1)..(2): n is 5-(N-benzylcarboxyamide)-2'-deoxyuridine
  misc_feature (5)..(6): n is hexaethylene glycol
  misc_feature (8)..(9): n is 5-(N-benzylcarboxyamide)-2'-deoxyuridine
  misc_feature (17)..(17): n is 5-[N-(1-naphthylmethyl)carboxyamide]-2'-deoxyuridine
  misc_feature (18)..(19): n is 5-(N-benzylcarboxyamide)-2'-deoxyuridine
  misc_feature (21)..(21): n is 5-(N-benzylcarboxyamide)-2'-deoxyuridine
nnacnngnnacacgcgnnnanagcg

SEQ ID NO: 90 - DNA, 25 bp, Artificial Sequence
  Synthetic
  misc_feature (1)..(2): n is 5-(N-benzylcarboxyamide)-2'-deoxyuridine
  misc_feature (5)..(6): n is hexaethylene glycol
  misc_feature (8)..(8): n is 2'-O-methyl-uridine
  misc_feature (9)..(9): n is 5-(N-benzylcarboxyamide)-2'-deoxyuridine
  misc_feature (17)..(19): n is 5-(N-benzylcarboxyamide)-2'-deoxyuridine
  misc_feature (21)..(21): n is 5-(N-benzylcarboxyamide)-2'-deoxyuridine
nnacnngnnacacgcgnnnanagcg

SEQ ID NO: 91 - DNA, 25 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(6): n is hexaethylene glycol
  misc_feature (8)..(8): n is 2'-O-methyl-uridine
  misc_feature (9)..(9): n is 5-(N-benzylcarboxyamide)-2'-deoxyuridine
  misc_feature (12)..(12): n is 2'-O-methyl-adenosine
  misc_feature (17)..(17): n is 5-[N-(1-naphthylmethyl)carboxyamide]-2'-deoxyuridine
  misc_feature (18)..(19): n is 5-(N-benzylcarboxyamide)-2'-deoxyuridine
  misc_feature (21)..(21): n is 5-(N-benzylcarboxyamide)-2'-deoxyuridine
  misc_feature (22)..(22): n is 2'-O-methyl-adenosine
  misc_feature (25)..(25): n is 2'-O-methyl-guanosine
nnncnngnnacncgcgnnnanngcn

SEQ ID NO: 92 - DNA, 25 bp, Artificial Sequence
  Synthetic
  misc_feature (1)..(1): n is 5-(N-benzylcarboxyamide)-2'-deoxyuridine
  misc_feature (2)..(2): n is 5-[N-(1-naphthylmethyl)carboxyamide]-2'-deoxyuridine
  misc_feature (3)..(3): n is 2'-O-methyl-adenosine
  misc_feature (5)..(6): n is hexaethylene glycol
  misc_feature (8)..(9): n is 5-[N-(1-naphthylmethyl)carboxyamide]-2'-deoxyuridine
  misc_feature (12)..(12): n is 2'-O-methyl-adenosine
  misc_feature (17)..(18): n is 5-[N-(1-naphthylmethyl)carboxyamide]-2'-deoxyuridine
  misc_feature (19)..(19): n is 5-(N-benzylcarboxyamide)-2'-deoxyuridine
  misc_feature (21)..(21): n is 5-[N-(1-naphthylmethyl)carboxyamide]-2'-deoxyuridine
  misc_feature (22)..(22): n is 2'-O-methyl-adenosine
  misc_feature (25)..(25): n is 2'-O-methyl-guanosine
nnncnngnnacncgcgnnnanngcn

SEQ ID NO: 93 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 94 - DNA, 24 bp, Artificial Sequence
  Synthetic
  misc_feature (1)..(2): n is 5-(N-benzylcarboxyamide)-2'-deoxyuridine
  misc_feature (5)..(5): n is hexaethylene glycol
  misc_feature (7)..(8): n is 5-(N-benzylcarboxyamide)-2'-deoxyuridine
  misc_feature (16)..(16): n is 5-[N-(1-naphthylmethyl)carboxyamide]-2'-deoxyuridine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
nnacngnnacacgcgnnnanagcg

SEQ ID NO: 95 - DNA, 24 bp, Artificial Sequence
  Synthetic
  misc_feature (1)..(2): n is 5-(N-benzylcarboxyamide)-2'-deoxyuridine
  misc_feature (5)..(5): n is hexaethylene glycol
  misc_feature (7)..(7): n is 2'-O-methyl-uridine
  misc_feature (8)..(8): n is 5-(N-benzylcarboxyamide)-2'-deoxyuridine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
nnacngnnacacgcgnnnanagcg

SEQ ID NO: 96 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (16)..(16): n is 5-[N-(1-naphthylmethyl)carboxyamide]-2'-deoxyuridine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 97 - DNA, 24 bp, Artificial Sequence
  Synthetic
  misc_feature (1)..(1): n is 5-[N-(phenyl-2-ethyl)-carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 98 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(phenyl-2-ethyl)-carboxyamide]-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 99 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-(phenyl-2-ethyl)-carboxyamide]-2'-deoxyuridine
  misc_feature (8)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 100 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-(phenyl-2-ethyl)-carboxyamide]-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 101 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-[N-(phenyl-2-ethyl)-carboxyamide]-2'-deoxyuridine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 102 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 103 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(17): n is 5-(N-benzylcarboxyamide)-2'-deoxyuridine
  misc_feature (18)..(18): n is 5-[N-(phenyl-2-ethyl)-carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 104 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-[N-(phenyl-2-ethyl)-carboxyamide]-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 105 - DNA, 24 bp, Artificial Sequence
  Synthetic
  misc_feature (1)..(1): n is 5-[N-(3-benzo[b]thiophene-2-ethyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 106 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3-benzo[b]thiophene-2-ethyl)carboxyamide]-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 107 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-(3-benzo[b]thiophene-2-ethyl)carboxyamide]-2'-deoxyuridine
  misc_feature (8)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 108 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-(3-benzo[b]thiophene-2-ethyl)carboxyamide]-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 109 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-[N-(3-benzo[b]thiophene-2-ethyl)carboxyamide]-2'-deoxyuridine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 110 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(3-benzo[b]thiophene-2-ethyl)carboxyamide]-2'-deoxyuridine
  misc_feature (18)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 111 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(17): n is 5-(N-benzylcarboxyamide)-2'-deoxyuridine
  misc_feature (18)..(18): n is 5-[N-(3-benzo[b]thiophene-2-ethyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 112 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-[N-(3-benzo[b]thiophene-2-ethyl)carboxyamide]-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 113 - DNA, 24 bp, Artificial Sequence
  Synthetic
  misc_feature (1)..(1): n is 5-[N-(2-thiophene-methyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 114 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(2-thiophene-methyl)carboxyamide]-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 115 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-(2-thiophene-methyl)carboxyamide]-2'-deoxyuridine
  misc_feature (8)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 116 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-(2-thiophene-methyl)carboxyamide]-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 117 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-[N-(2-thiophene-methyl)carboxyamide]-2'-deoxyuridine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 118 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(2-thiophene-methyl)carboxyamide]-2'-deoxyuridine
  misc_feature (18)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 119 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(17): n is 5-(N-benzylcarboxyamide)-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 120 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-[N-(2-thiophene-methyl)carboxyamide]-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 121 - DNA, 24 bp, Artificial Sequence
  Synthetic
  misc_feature (1)..(1): n is 5-[N-(1-naphthylmethyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 122 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(1-naphthylmethyl)carboxyamide]-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 123 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-(1-naphthylmethyl)carboxyamide]-2'-deoxyuridine
  misc_feature (8)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 124 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-(1-naphthylmethyl)carboxyamide]-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 125 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-[N-(1-naphthylmethyl)carboxyamide]-2'-deoxyuridine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 126 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(1-naphthylmethyl)carboxyamide]-2'-deoxyuridine
  misc_feature (18)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 127 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(17): n is 5-(N-benzylcarboxyamide)-2'-deoxyuridine
  misc_feature (18)..(18): n is 5-[N-(1-naphthylmethyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 128 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-[N-(1-naphthylmethyl)carboxyamide]-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 129 - DNA, 24 bp, Artificial Sequence
  Synthetic
  misc_feature (1)..(1): n is 5-[N-isobutyl-carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 130 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-isobutyl-carboxyamide]-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 131 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-isobutyl-carboxyamide]-2'-deoxyuridine
  misc_feature (8)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 132 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-isobutyl-carboxyamide]-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 133 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-[N-isobutyl-carboxyamide]-2'-deoxyuridine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 134 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-isobutyl-carboxyamide]-2'-deoxyuridine
  misc_feature (18)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 135 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(17): n is 5-(N-benzylcarboxyamide)-2'-deoxyuridine
  misc_feature (18)..(18): n is 5-[N-isobutyl-carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 136 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-[N-isobutyl-carboxyamide]-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 137 - DNA, 24 bp, Artificial Sequence
  Synthetic
  misc_feature (1)..(1): n is 5-[N-(3-indole-2-ethyl)-carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 138 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3-indole-2-ethyl)-carboxyamide]-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 139 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-(3-indole-2-ethyl)-carboxyamide]-2'-deoxyuridine
  misc_feature (8)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 140 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(17): n is 5-(N-benzylcarboxyamide)-2'-deoxyuridine
  misc_feature (18)..(18): n is 5-[N-(3-indole-2-ethyl)-carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 141 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-[N-(3-indole-2-ethyl)-carboxyamide]-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 142 - DNA, 24 bp, Artificial Sequence
  Synthetic
  misc_feature (1)..(1): n is 5-[N-(2-naphthylmethyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 143 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(2-naphthylmethyl)carboxyamide]-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 144 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-(2-naphthylmethyl)carboxyamide]-2'-deoxyuridine
  misc_feature (8)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 145 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-[N-(2-naphthylmethyl)carboxyamide]-2'-deoxyuridine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 146 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(2-naphthylmethyl)carboxyamide]-2'-deoxyuridine
  misc_feature (18)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 147 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(17): n is 5-(N-benzylcarboxyamide)-2'-deoxyuridine
  misc_feature (18)..(18): n is 5-[N-(2-naphthylmethyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 148 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-[N-(2-naphthylmethyl)carboxyamide]-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 149 - DNA, 24 bp, Artificial Sequence
  Synthetic
  misc_feature (1)..(1): n is 5-[N-(2-naphthyl-2-ethyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 150 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(2-naphthyl-2-ethyl)carboxyamide]-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 151 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-(2-naphthyl-2-ethyl)carboxyamide]-2'-deoxyuridine
  misc_feature (8)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 152 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-(2-naphthyl-2-ethyl)carboxyamide]-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 153 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-[N-(2-naphthyl-2-ethyl)carboxyamide]-2'-deoxyuridine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 154 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(17): n is 5-(N-benzylcarboxyamide)-2'-deoxyuridine
  misc_feature (18)..(18): n is 5-[N-(2-naphthyl-2-ethyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 155 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-[N-(2-naphthyl-2-ethyl)carboxyamide]-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 156 - DNA, 24 bp, Artificial Sequence
  Synthetic
  misc_feature (1)..(1): n is 5-[N-(1-naphthyl-2-ethyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 157 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(1-naphthyl-2-ethyl)carboxyamide]-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 158 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-(1-naphthyl-2-ethyl)carboxyamide]-2'-deoxyuridine
  misc_feature (8)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 159 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-(1-naphthyl-2-ethyl)carboxyamide]-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 160 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-[N-(1-naphthyl-2-ethyl)carboxyamide]-2'-deoxyuridine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 161 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(1-naphthyl-2-ethyl)carboxyamide]-2'-deoxyuridine
  misc_feature (18)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 162 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(17): n is 5-(N-benzylcarboxyamide)-2'-deoxyuridine
  misc_feature (18)..(18): n is 5-[N-(1-naphthyl-2-ethyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 163 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-[N-(1-naphthyl-2-ethyl)carboxyamide]-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 164 - DNA, 24 bp, Artificial Sequence
  Synthetic
  misc_feature (1)..(1): n is 5-[N-(3,4-methylenedioxyphenyl-methyl)carboxyamide]-2'-deoxyuridi ne
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 165 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 166 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-(3,4-methylenedioxyphenyl-methyl)carboxyamide]-2'-deoxyuridi ne
  misc_feature (8)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 167 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-(3,4-methylenedioxyphenyl-methyl)carboxyamide]-2'-deoxyuridi ne
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 168 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-[N-(3,4-methylenedioxyphenyl-methyl)carboxyamide]-2'-deoxyuridi ne
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 169 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(3,4-methylenedioxyphenyl-methyl)carboxyamide]-2'-deoxyuridi ne
  misc_feature (18)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 170 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(17): n is 5-(N-benzylcarboxyamide)-2'-deoxyuridine
  misc_feature (18)..(18): n is 5-[N-(3,4-methylenedioxyphenyl-methyl)carboxyamide]-2'-deoxyuridi ne
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 171 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-[N-(3,4-methylenedioxyphenyl-methyl)carboxyamide]-2'-deoxyuridi ne
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 172 - DNA, 24 bp, Artificial Sequence
  Synthetic
  misc_feature (1)..(1): n is 5-[N-(phenyl-3-propyl)-carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 173 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(phenyl-3-propyl)-carboxyamide]-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 174 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-(phenyl-3-propyl)-carboxyamide]-2'-deoxyuridine
  misc_feature (8)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 175 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-(phenyl-3-propyl)-carboxyamide]-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 176 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-[N-(phenyl-3-propyl)-carboxyamide]-2'-deoxyuridine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 177 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-3-propyl)-carboxyamide]-2'-deoxyuridine
  misc_feature (18)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 178 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(17): n is 5-(N-benzylcarboxyamide)-2'-deoxyuridine
  misc_feature (18)..(18): n is 5-[N-(phenyl-3-propyl)-carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 179 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-[N-(phenyl-3-propyl)-carboxyamide]-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 180 - DNA, 24 bp, Artificial Sequence
  Synthetic
  misc_feature (1)..(1): n is 5-[N-(4-hydroxyphenyl-2-ethyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 181 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(4-hydroxyphenyl-2-ethyl)carboxyamide]-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 182 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-(4-hydroxyphenyl-2-ethyl)carboxyamide]-2'-deoxyuridine
  misc_feature (8)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 183 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-(4-hydroxyphenyl-2-ethyl)carboxyamide]-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 184 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-[N-(4-hydroxyphenyl-2-ethyl)carboxyamide]-2'-deoxyuridine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 185 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(4-hydroxyphenyl-2-ethyl)carboxyamide]-2'-deoxyuridine
  misc_feature (18)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 186 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(17): n is 5-(N-benzylcarboxyamide)-2'-deoxyuridine
  misc_feature (18)..(18): n is 5-[N-(4-hydroxyphenyl-2-ethyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 187 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-[N-(4-hydroxyphenyl-2-ethyl)carboxyamide]-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 188 - DNA, 24 bp, Artificial Sequence
  Synthetic
  misc_feature (1)..(1): n is 5-[N-(4-fluorobenzyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 189 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(4-fluorobenzyl)carboxyamide]-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 190 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-(4-fluorobenzyl)carboxyamide]-2'-deoxyuridine
  misc_feature (8)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 191 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-(4-fluorobenzyl)carboxyamide]-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 192 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-[N-(4-fluorobenzyl)carboxyamide]-2'-deoxyuridine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 193 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(4-fluorobenzyl)carboxyamide]-2'-deoxyuridine
  misc_feature (18)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 194 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(17): n is 5-(N-benzylcarboxyamide)-2'-deoxyuridine
  misc_feature (18)..(18): n is 5-[N-(4-fluorobenzyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 195 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-[N-(4-fluorobenzyl)carboxyamide]-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 196 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (4)..(4): n is 2'-fluoro-2'-deoxycytidine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnnnngnnacncgcgnnnanngcn

SEQ ID NO: 197 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (10)..(10): n is 2'-fluoro-2'-deoxycytidine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnanncgcgnnnanngcn

SEQ ID NO: 198 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-fluoro-2'-deoxycytidine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnanngcn

SEQ ID NO: 199 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (14)..(14): n is 2'-fluoro-2'-deoxycytidine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgngnnnanngcn

SEQ ID NO: 200 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (23)..(23): n is 2'-fluoro-2'-deoxycytidine
  misc_feature (24)..(24): n is 2'-O-methyl-guanosine
nnncngnnacncgcgnnnanngnn

SEQ ID NO: 201 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnnnngcn

SEQ ID NO: 202 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (6)..(6): n is 2'-O-methyl-guanosine
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncnnnnacncgcgnnnanngcn

SEQ ID NO: 203 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (13)..(13): n is 2'-O-methyl-guanosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncncgnnnanngcn

SEQ ID NO: 204 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (15)..(15): n is 2'-O-methyl-guanosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcnnnnanngcn

SEQ ID NO: 205 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (22)..(22): n is 2'-O-methyl-guanosine
  misc_feature (24)..(24): n is 2'-O-methyl-guanosine
nnncngnnacncgcgnnnannncn

SEQ ID NO: 206 - DNA, 24 bp, Artificial Sequence
  Synthetic
  misc_feature (1)..(1): n is 5-[N-(4-hydroxyphenyl-2-ethyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-(4-fluorobenzyl)carboxyamide]-2'-deoxyuridine
  misc_feature (8)..(8): n is 5-(N-benzylcarboxyamide)-2'-deoxyuridine
  misc_feature (11)..(11): n is 2'-O-methyl-adenosine
  misc_feature (16)..(16): n is 5-[N-(2-naphthylmethyl)carboxyamide]-2'-deoxyuridine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 207 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-isobutyl-carboxyamide]-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 208 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-(2-naphthylmethyl)carboxyamide]-2'-deoxyuridine
  misc_feature (8)..(8): n is 5-[N-isobutyl-carboxyamide]-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 209 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-(1-naphthyl-2-ethyl)carboxyamide]-2'-deoxyuridine
  misc_feature (8)..(8): n is 5-[N-isobutyl-carboxyamide]-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 210 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-[N-isobutyl-carboxyamide]-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 211 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 212 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(18): n is 5-[N-(phenyl-2-ethyl)-carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 213 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 214 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-[N-(2-naphthylmethyl)carboxyamide]-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 215 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-[N-(2-thiophene-methyl)carboxyamide]-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 216 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-[N-isobutyl-carboxyamide]-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 217 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-isobutyl-carboxyamide]-2'-deoxyuridine
  misc_feature (11)..(11): n is 2'-O-methyl-adenosine
  misc_feature (16)..(16): n is 5-[N-(2-thiophene-methyl)carboxyamide]-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 218 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-isobutyl-carboxyamide]-2'-deoxyuridine
  misc_feature (3)..(3): n is 2'-O-methyl-adenosine
  misc_feature (5)..(5): n is hexaethylene glycol
  misc_feature (7)..(8): n is 5-[N-isobutyl-carboxyamide]-2'-deoxyuridine
  misc_feature (11)..(11): n is 2'-O-methyl-adenosine
  misc_feature (16)..(16): n is 5-[N-isobutyl-carboxyamide]-2'-deoxyuridine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 219 - DNA, 24 bp, Artificial Sequence
  Synthetic
  misc_feature (1)..(2): n is 5-[N-(2-naphthylmethyl)carboxyamide]-2'-deoxyuridine
  misc_feature (3)..(3): n is 2'-O-methyl-adenosine
  misc_feature (5)..(5): n is hexaethylene glycol
  misc_feature (7)..(7): n is 5-[N-(2-naphthylmethyl)carboxyamide]-2'-deoxyuridine
  misc_feature (8)..(8): n is 5-(N-benzylcarboxyamide)-2'-deoxyuridine
  misc_feature (11)..(11): n is 2'-O-methyl-adenosine
  misc_feature (16)..(16): n is 5-[N-(2-naphthylmethyl)carboxyamide]-2'-deoxyuridine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 220 - DNA, 24 bp, Artificial Sequence
  Synthetic
  misc_feature (1)..(1): n is 5-[N-(1-naphthyl-2-ethyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-(1-naphthyl-2-ethyl)carboxyamide]-2'-deoxyuridine
  misc_feature (8)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-[N-(1-naphthyl-2-ethyl)carboxyamide]-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 221 - DNA, 24 bp, Artificial Sequence
  Synthetic
  misc_feature (1)..(1): n is 5-[N-(2-thiophene-methyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-[N-(2-thiophene-methyl)carboxyamide]-2'-deoxyuridine
  misc_feature (17)..(17): n is 5-(N-benzylcarboxyamide)-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 222 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(18): n is 5-(N-benzylcarboxyamide)-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (22)..(22): n is 2'-O-methyl-guanosine
  misc_feature (24)..(24): n is 2'-O-methyl-guanosine
nnncngnnacnngcgnnnnnnncn

SEQ ID NO: 223 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (22)..(22): n is 2'-O-methyl-guanosine
  misc_feature (24)..(24): n is 2'-O-methyl-guanosine
nnncngnnacncgcgnnnnnnncn

SEQ ID NO: 224 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(18): n is 5-(N-benzylcarboxyamide)-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 225 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (22)..(22): n is 2'-O-methyl-guanosine
  misc_feature (24)..(24): n is 2'-O-methyl-guanosine
nnncngnnacnngcgnnnannncn

SEQ ID NO: 226 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-isobutyl-carboxyamide]-2'-deoxyuridine
  misc_feature (11)..(11): n is 2'-O-methyl-adenosine
  misc_feature (16)..(16): n is 5-[N-(2-naphthylmethyl)carboxyamide]-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 227 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-isobutyl-carboxyamide]-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnanngcn

SEQ ID NO: 228 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-isobutyl-carboxyamide]-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnnnngcn

SEQ ID NO: 229 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-isobutyl-carboxyamide]-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (22)..(22): n is 2'-O-methyl-guanosine
  misc_feature (24)..(24): n is 2'-O-methyl-guanosine
nnncngnnacncgcgnnnannncn

SEQ ID NO: 230 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-isobutyl-carboxyamide]-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 231 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-isobutyl-carboxyamide]-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (22)..(22): n is 2'-O-methyl-guanosine
  misc_feature (24)..(24): n is 2'-O-methyl-guanosine
nnncngnnacnngcgnnnnnnncn

SEQ ID NO: 232 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-fluoro-2'-deoxycytidine
  misc_feature (16)..(18): n is 5-(N-benzylcarboxyamide)-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 233 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (10)..(10): n is 2'-O-methyl-cytidine
  misc_feature (11)..(11): n is 2'-O-methyl-adenosine
  misc_feature (12)..(12): n is 2'-O-methyl-cytidine
  misc_feature (16)..(18): n is 5-(N-benzylcarboxyamide)-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (23)..(23): n is 2'-O-methyl-cytidine
  misc_feature (24)..(24): n is 2'-O-methyl-guanosine
nnncngnnannngcgnnnnnngnn

SEQ ID NO: 234 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (10)..(10): n is 2'-O-methyl-cytidine
  misc_feature (11)..(11): n is 2'-O-methyl-adenosine
  misc_feature (12)..(12): n is 2'-O-methyl-cytidine
  misc_feature (16)..(18): n is 5-(N-benzylcarboxyamide)-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (22)..(22): n is 2'-O-methyl-guanosine
  misc_feature (23)..(23): n is 2'-O-methyl-cytidine
  misc_feature (24)..(24): n is 2'-O-methyl-guanosine
nnncngnnannngcgnnnnnnnnn

SEQ ID NO: 235 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(12): n is 1,3-propane diol
  misc_feature (16)..(18): n is 5-(N-benzylcarboxyamide)-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 236 - DNA, 23 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 1,3-propane diol
  misc_feature (15)..(17): n is 5-(N-benzylcarboxyamide)-2'-deoxyuridine
  misc_feature (18)..(18): n is 2'-O-methyl-adenosine
  misc_feature (19)..(19): n is 5-(N-benzylcarboxyamide)-2'-deoxyuridine
  misc_feature (20)..(20): n is 2'-O-methyl-adenosine
  misc_feature (23)..(23): n is 2'-O-methyl-guanosine
nnncngnnacngcgnnnnnngcn

SEQ ID NO: 237 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(18): n is 5-(N-benzylcarboxyamide)-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 238 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 1,3-propane diol
  misc_feature (16)..(18): n is 5-(N-benzylcarboxyamide)-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 239 - DNA, 23 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is hexaethylene glycol
  misc_feature (15)..(17): n is 5-(N-benzylcarboxyamide)-2'-deoxyuridine
  misc_feature (18)..(18): n is 2'-O-methyl-adenosine
  misc_feature (19)..(19): n is 5-(N-benzylcarboxyamide)-2'-deoxyuridine
  misc_feature (20)..(20): n is 2'-O-methyl-adenosine
  misc_feature (23)..(23): n is 2'-O-methyl-guanosine
nnncngnnacngcgnnnnnngcn

SEQ ID NO: 240 - DNA, 29 bp, Artificial Sequence
  Synthetic
  misc_feature (1)..(2): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgcacgcgnnacacgcgnnnanagcg

SEQ ID NO: 241 - DNA, 27 bp, Artificial Sequence
  Synthetic
  misc_feature (1)..(2): n is 5-(N-benzylcarboxyamide)-2'-deoxyuridine
  misc_feature (10)..(11): n is 5-(N-benzylcarboxyamide)-2'-deoxyuridine
  misc_feature (19)..(21): n is 5-(N-benzylcarboxyamide)-2'-deoxyuridine
  misc_feature (23)..(23): n is 5-(N-benzylcarboxyamide)-2'-deoxyuridine
nnaccacggnnacacgcgnnnanagcg

SEQ ID NO: 242 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnactcgcgnnnanngcn

SEQ ID NO: 243 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacccgcgnnnanngcn

SEQ ID NO: 244 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacgcgcgnnnanngcn

SEQ ID NO: 245 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacntgcgnnnanngcn

SEQ ID NO: 246 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnagcgnnnanngcn

SEQ ID NO: 247 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnggcgnnnanngcn

SEQ ID NO: 248 - DNA, 23 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (15)..(17): n is 5-(N-benzylcarboxyamide)-2'-deoxyuridine
  misc_feature (19)..(19): n is 5-(N-benzylcarboxyamide)-2'-deoxyuridine
  misc_feature (20)..(20): n is 2'-O-methyl-adenosine
  misc_feature (23)..(23): n is 2'-O-methyl-guanosine
nnncngnnactgcgnnnanngcn

SEQ ID NO: 249 - DNA, 23 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (15)..(17): n is 5-(N-benzylcarboxyamide)-2'-deoxyuridine
  misc_feature (19)..(19): n is 5-(N-benzylcarboxyamide)-2'-deoxyuridine
  misc_feature (20)..(20): n is 2'-O-methyl-adenosine
  misc_feature (23)..(23): n is 2'-O-methyl-guanosine
nnncngnnacagcgnnnanngcn

SEQ ID NO: 250 - DNA, 23 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (15)..(17): n is 5-(N-benzylcarboxyamide)-2'-deoxyuridine
  misc_feature (19)..(19): n is 5-(N-benzylcarboxyamide)-2'-deoxyuridine
  misc_feature (20)..(20): n is 2'-O-methyl-adenosine
  misc_feature (23)..(23): n is 2'-O-methyl-guanosine
nnncngnnacggcgnnnanngcn

SEQ ID NO: 251 - DNA, 23 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (15)..(17): n is 5-(N-benzylcarboxyamide)-2'-deoxyuridine
  misc_feature (19)..(19): n is 5-(N-benzylcarboxyamide)-2'-deoxyuridine
  misc_feature (20)..(20): n is 2'-O-methyl-adenosine
  misc_feature (23)..(23): n is 2'-O-methyl-guanosine
nnncngnnaccgcgnnnanngcn

SEQ ID NO: 252 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 253 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-(N-benzylcarboxyamide)-2'-O-methyl-uridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 254 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 255 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-O-methyl-uridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 256 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-deoxyuridine
  misc_feature (20)..(20): n is 5-[N-(3,4-methylenedioxyphenyl-methyl)carboxyamide]-2'-deoxyuridi ne
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 257 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-[N-(3,4-methylenedioxyphenyl-methyl)carboxyamide]-2'-deoxyuridi ne
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 258 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 259 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-[N-(2-thiophene-methyl)carboxyamide]-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 260 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(18): n is 5-(N-benzylcarboxyamide)-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 261 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 262 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 263 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 264 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(18): n is 5-(N-benzylcarboxyamide)-2'-deoxyuridine
  misc_feature (19)..(19): n is 2'-O-methyl-adenosine
  misc_feature (20)..(20): n is 5-[N-(3,4-methylenedioxyphenyl-methyl)carboxyamide]-2'-deoxyuridi ne
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 265 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-deoxyuridine
  misc_feature (19)..(19): n is 2'-O-methyl-adenosine
  misc_feature (20)..(20): n is 5-[N-(3,4-methylenedioxyphenyl-methyl)carboxyamide]-2'-deoxyuridi ne
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 266 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (19)..(19): n is 2'-O-methyl-adenosine
  misc_feature (20)..(20): n is 5-[N-(3,4-methylenedioxyphenyl-methyl)carboxyamide]-2'-deoxyuridi ne
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 267 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-deoxyuridine
  misc_feature (19)..(19): n is 2'-O-methyl-adenosine
  misc_feature (20)..(20): n is 5-[N-(3,4-methylenedioxyphenyl-methyl)carboxyamide]-2'-deoxyuridi ne
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 268 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (19)..(19): n is 2'-O-methyl-adenosine
  misc_feature (20)..(20): n is 5-[N-(3,4-methylenedioxyphenyl-methyl)carboxyamide]-2'-deoxyuridi ne
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 269 - DNA, 50 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(26): n is hexaethylene glycol
  misc_feature (27)..(28): n is 5-(N-benzylcarboxyamide)-2'-deoxyuridine
  misc_feature (29)..(29): n is 2'-O-methyl-adenosine
  misc_feature (31)..(31): n is hexaethylene glycol
  misc_feature (33)..(34): n is 5-(N-benzylcarboxyamide)-2'-deoxyuridine
  misc_feature (37)..(37): n is 2'-O-methyl-adenosine
  misc_feature (42)..(42): n is 5-(N-benzylcarboxyamide)-2'-deoxyuridine
  misc_feature (43)..(43): n is 5-[N-(phenyl-2-ethyl)-carboxyamide]-2'-deoxyuridine
  misc_feature (44)..(44): n is 5-[N-(2-thiophene-methyl)carboxyamide]-2'-deoxyuridine
  misc_feature (46)..(46): n is 5-(N-benzylcarboxyamide)-2'-deoxyuridine
  misc_feature (47)..(47): n is 2'-O-methyl-adenosine
  misc_feature (50)..(50): n is 2'-O-methyl-guanosine
nnncngnnacncgcgnnnanngcnnnnnncngnnacncgcgnnnanngcn

SEQ ID NO: 270 - DNA, 51 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(27): n is hexaethylene glycol
  misc_feature (28)..(29): n is 5-(N-benzylcarboxyamide)-2'-deoxyuridine
  misc_feature (30)..(30): n is 2'-O-methyl-adenosine
  misc_feature (32)..(32): n is hexaethylene glycol
  misc_feature (34)..(35): n is 5-(N-benzylcarboxyamide)-2'-deoxyuridine
  misc_feature (38)..(38): n is 2'-O-methyl-adenosine
  misc_feature (43)..(43): n is 5-(N-benzylcarboxyamide)-2'-deoxyuridine
  misc_feature (44)..(44): n is 5-[N-(phenyl-2-ethyl)-carboxyamide]-2'-deoxyuridine
  misc_feature (45)..(45): n is 5-[N-(2-thiophene-methyl)carboxyamide]-2'-deoxyuridine
  misc_feature (47)..(47): n is 5-(N-benzylcarboxyamide)-2'-deoxyuridine
  misc_feature (48)..(48): n is 2'-O-methyl-adenosine
  misc_feature (51)..(51): n is 2'-O-methyl-guanosine
nnncngnnacncgcgnnnanngcnnnnnnncngnnacncgcgnnnanngcn

SEQ ID NO: 271 - DNA, 52 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(28): n is hexaethylene glycol
  misc_feature (29)..(30): n is 5-(N-benzylcarboxyamide)-2'-deoxyuridine
  misc_feature (31)..(31): n is 2'-O-methyl-adenosine
  misc_feature (33)..(33): n is hexaethylene glycol
  misc_feature (35)..(36): n is 5-(N-benzylcarboxyamide)-2'-deoxyuridine
  misc_feature (39)..(39): n is 2'-O-methyl-adenosine
  misc_feature (44)..(44): n is 5-(N-benzylcarboxyamide)-2'-deoxyuridine
  misc_feature (45)..(45): n is 5-[N-(phenyl-2-ethyl)-carboxyamide]-2'-deoxyuridine
  misc_feature (46)..(46): n is 5-[N-(2-thiophene-methyl)carboxyamide]-2'-deoxyuridine
  misc_feature (48)..(48): n is 5-(N-benzylcarboxyamide)-2'-deoxyuridine
  misc_feature (49)..(49): n is 2'-O-methyl-adenosine
  misc_feature (52)..(52): n is 2'-O-methyl-guanosine
nnncngnnacncgcgnnnanngcnnnnnnnncngnnacncgcgnnnanngcn

SEQ ID NO: 272 - DNA, 53 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(29): n is hexaethylene glycol
  misc_feature (30)..(31): n is 5-(N-benzylcarboxyamide)-2'-deoxyuridine
  misc_feature (32)..(32): n is 2'-O-methyl-adenosine
  misc_feature (34)..(34): n is hexaethylene glycol
  misc_feature (36)..(37): n is 5-(N-benzylcarboxyamide)-2'-deoxyuridine
  misc_feature (40)..(40): n is 2'-O-methyl-adenosine
  misc_feature (45)..(45): n is 5-(N-benzylcarboxyamide)-2'-deoxyuridine
  misc_feature (46)..(46): n is 5-[N-(phenyl-2-ethyl)-carboxyamide]-2'-deoxyuridine
  misc_feature (47)..(47): n is 5-[N-(2-thiophene-methyl)carboxyamide]-2'-deoxyuridine
  misc_feature (49)..(49): n is 5-(N-benzylcarboxyamide)-2'-deoxyuridine
  misc_feature (50)..(50): n is 2'-O-methyl-adenosine
  misc_feature (53)..(53): n is 2'-O-methyl-guanosine
nnncngnnacncgcgnnnanngcnnnnnnnnncngnnacncgcgnnnanngcn

SEQ ID NO: 273 - DNA, 54 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(30): n is hexaethylene glycol
  misc_feature (31)..(32): n is 5-(N-benzylcarboxyamide)-2'-deoxyuridine
  misc_feature (33)..(33): n is 2'-O-methyl-adenosine
  misc_feature (35)..(35): n is hexaethylene glycol
  misc_feature (37)..(38): n is 5-(N-benzylcarboxyamide)-2'-deoxyuridine
  misc_feature (41)..(41): n is 2'-O-methyl-adenosine
  misc_feature (46)..(46): n is 5-(N-benzylcarboxyamide)-2'-deoxyuridine
  misc_feature (47)..(47): n is 5-[N-(phenyl-2-ethyl)-carboxyamide]-2'-deoxyuridine
  misc_feature (48)..(48): n is 5-[N-(2-thiophene-methyl)carboxyamide]-2'-deoxyuridine
  misc_feature (50)..(50): n is 5-(N-benzylcarboxyamide)-2'-deoxyuridine
  misc_feature (51)..(51): n is 2'-O-methyl-adenosine
  misc_feature (54)..(54): n is 2'-O-methyl-guanosine
nnncngnnacncgcgnnnanngcnnnnnnnnnncngnnacncgcgnnnanngcn

SEQ ID NO: 274 - DNA, 27 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(25): n is 1,3-propane diol
  misc_feature (26)..(26): n is 1,3-bis-[5-hydroxy-pentylamido]-2-propanol
nnncngnnacncgcgnnnanngcnnnt

SEQ ID NO: 275 - DNA, 27 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(25): n is hexaethylene glycol
  misc_feature (26)..(26): n is 1,3-bis-[5-hydroxy-pentylamido]-2-propanol
nnncngnnacncgcgnnnanngcnnnt

SEQ ID NO: 276 - DNA, 28 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(26): n is hexaethylene glycol
  misc_feature (27)..(27): n is 1,3-bis-[5-hydroxy-pentylamido]-2-propanol
nnncngnnacncgcgnnnanngcnnnnt

SEQ ID NO: 277 - DNA, 29 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(27): n is hexaethylene glycol
  misc_feature (28)..(28): n is 1,3-bis-[5-hydroxy-pentylamido]-2-propanol
nnncngnnacncgcgnnnanngcnnnnnt

SEQ ID NO: 278 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (18)..(18): n is 5-[N-(2-thiophene-methyl)carboxyamide]-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 279 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (6)..(6): n is 2'-fluoro-2'-deoxy-guanosine
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncnnnnacnngcgnnnnnngcn

SEQ ID NO: 280 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (13)..(13): n is 2'-fluoro-2'-deoxy-guanosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnnncgnnnnnngcn

SEQ ID NO: 281 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (15)..(15): n is 2'-fluoro-2'-deoxy-guanosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcnnnnnnngcn

SEQ ID NO: 282 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (22)..(22): n is 2'-fluoro-2'-deoxy-guanosine
  misc_feature (24)..(24): n is 2'-O-methyl-guanosine
nnncngnnacnngcgnnnnnnncn

SEQ ID NO: 283 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (4)..(4): n is 2'-fluoro-2'-deoxycytidine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n si 2'-O-methyl-guanosine
nnnnngnnacnngcgnnnnnngcn

SEQ ID NO: 284 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (23)..(23): n is 2'-fluoro-2'-deoxycytidine
  misc_feature (24)..(24): n is 2'-O-methyl-guanosine
nnncngnnacnngcgnnnnnngnn

SEQ ID NO: 285 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (9)..(9): n is 2'-fluoro-2'-deoxyadenosine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcgnnnnnngcn

SEQ ID NO: 286 - DNA, 24 bp, Artificial Sequence
  Synthetic
  misc_feature (1)..(1): n is 5-[N-(2-naphthylmethyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 287 - DNA, 24 bp, Artificial Sequence
  Synthetic
  misc_feature (1)..(1): n is 5-[N-(4-fluorobenzyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 288 - DNA, 24 bp, Artificial Sequence
  Synthetic
  misc_feature (1)..(1): n is 5-[N-(1-naphthyl-2-ethyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 289 - DNA, 24 bp, Artificial Sequence
  Synthetic
  misc_feature (1)..(1): n is 5-[N-(2-naphthyl-2-ethyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 290 - DNA, 24 bp, Artificial Sequence
  Synthetic
  misc_feature (1)..(1): n is 5-[N-(phenyl-3-propyl)-carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 291 - DNA, 24 bp, Artificial Sequence
  Synthetic
  misc_feature (1)..(1): n is 5-[N-isobutyl-carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 292 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 293 - DNA, 24 bp, Artificial Sequence
  Synthetic
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
tnncngnnacncgcgnnnanngcn

SEQ ID NO: 294 - DNA, 24 bp, Artificial Sequence
  Synthetic
  misc_feature (1)..(1): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
ntncngnnacncgcgnnnanngcn

SEQ ID NO: 295 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (8)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngtnacncgcgnnnanngcn

SEQ ID NO: 296 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcgnnnnnngcn

SEQ ID NO: 297 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcgnnnnnngcn

SEQ ID NO: 298 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (15)..(15): n is 2'-deoxyguanosine-3'-phosphorothioate
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcnnnnnnngcn

SEQ ID NO: 299 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (15)..(15): n is 2'-deoxyguanosine-3'-phosphorothioate
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcnnnnnnngcn

SEQ ID NO: 300 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 2'-O-methyl-adenosine
  misc_feature (12)..(12): n is 2'-O-methyl-cytidine
  misc_feature (15)..(15): n is 2'-deoxyguanosine-3'-phosphorothioate
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 301 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 2'-O-methyl-adenosine
  misc_feature (12)..(12): n is 2'-O-methyl-cytidine
  misc_feature (15)..(15): n is 2'-deoxyguanosine-3'-phosphorothioate
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 302 - DNA, 24 bp, Artificial Sequence
  Synthetic
  misc_feature (1)..(1): n is 5-[N-(4-fluorobenzyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 303 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 304 - DNA, 24 bp, Artificial Sequence
  Synthetic
  misc_feature (1)..(1): n is 5-[N-(4-fluorobenzyl)carboxyamide]-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 305 - DNA, 24 bp, Artificial Sequence
  Synthetic
  misc_feature (1)..(1): n is 5-[N-(4-fluorobenzyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 306 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 307 - DNA, 24 bp, Artificial Sequence
  Synthetic
  misc_feature (1)..(1): n is 5-[N-(4-fluorobenzyl)carboxyamide]-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 308 - DNA, 24 bp, Artificial Sequence
  Synthetic
  misc_feature (1)..(1): n is 5-[N-(4-fluorobenzyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 309 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 310 - DNA, 24 bp, Artificial Sequence
  Synthetic
  misc_feature (1)..(1): n is 5-[N-(4-fluorobenzyl)carboxyamide]-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 311 - DNA, 24 bp, Artificial Sequence
  Synthetic
  misc_feature (1)..(1): n is 5-[N-(4-fluorobenzyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 312 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 313 - DNA, 24 bp, Artificial Sequence
  Synthetic
  misc_feature (1)..(1): n is 5-[N-(4-fluorobenzyl)carboxyamide]-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcgnnnnnngcn

SEQ ID NO: 314 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 2'-O-methyl-adenosine
  misc_feature (12)..(12): n is 2'-O-methyl-cytidine
  misc_feature (15)..(15): n is 2'-deoxyguanosine-3'-phosphorothioate
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 315 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 2'-O-methyl-adenosine
  misc_feature (12)..(12): n is 2'-O-methyl-cytidine
  misc_feature (15)..(15): n is 2'-deoxyguanosine-3'-phosphorothioate
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 316 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 1,3-propane diol
  misc_feature (12)..(12): n is 2'-O-methyl-cytidine
  misc_feature (15)..(15): n is 2'-deoxyguanosine-3'-phosphorothioate
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 317 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 1,3-propane diol
  misc_feature (12)..(12): n is 2'-O-methyl-cytidine
  misc_feature (15)..(15): n is 2'-deoxyguanosine-3'-phosphorothioate
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 318 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 1,3-propane diol
  misc_feature (12)..(12): n is 2'-O-methyl-cytidine
  misc_feature (15)..(15): n is 2'-deoxyguanosine-3'-phosphorothioate
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 319 - DNA, 24 bp, Artificial Sequence
  Synthetic
  misc_feature (1)..(1): n is 5-[N-(4-fluorobenzyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 2'-O-methyl-adenosine
  misc_feature (12)..(12): n is 2'-O-methyl-cytidine
  misc_feature (15)..(15): n is 2'-deoxyguanosine-3'-phosphorothioate
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 320 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 2'-O-methyl-adenosine
  misc_feature (12)..(12): n is 2'-O-methyl-cytidine
  misc_feature (15)..(15): n is 2'-deoxyguanosine-3'-phosphorothioate
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 321 - DNA, 24 bp, Artificial Sequence
  Synthetic
  misc_feature (1)..(1): n is 5-[N-(4-fluorobenzyl)carboxyamide]-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 2'-O-methyl-adenosine
  misc_feature (12)..(12): n is 2'-O-methyl-cytidine
  misc_feature (15)..(15): n is 2'-deoxyguanosine-3'-phosphorothioate
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 322 - DNA, 24 bp, Artificial Sequence
  Synthetic
  misc_feature (1)..(1): n is 5-[N-(4-fluorobenzyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 1,3-propane diol
  misc_feature (12)..(12): n is 2'-O-methyl-cytidine
  misc_feature (15)..(15): n is 2'-deoxyguanosine-3'-phosphorothioate
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 323 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 1,3-propane diol
  misc_feature (12)..(12): n is 2'-O-methyl-cytidine
  misc_feature (15)..(15): n is 2'-deoxyguanosine-3'-phosphorothioate
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 324 - DNA, 24 bp, Artificial Sequence
  Synthetic
  misc_feature (1)..(1): n is 5-[N-(4-fluorobenzyl)carboxyamide]-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 1,3-propane diol
  misc_feature (12)..(12): n is 2'-O-methyl-cytidine
  misc_feature (15)..(15): n is 2'-deoxyguanosine-3'-phosphorothioate
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 325 - DNA, 24 bp, Artificial Sequence
  Synthetic
  misc_feature (1)..(1): n is 5-[N-(4-fluorobenzyl)carboxyamide]-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 1,3-propane diol
  misc_feature (12)..(12): n is 2'-O-methyl-cytidine
  misc_feature (15)..(15): n is 2'-deoxyguanosine-3'-phosphorothioate
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 326 - DNA, 24 bp, Artificial Sequence
  Synthetic
  misc_feature (1)..(1): n is 5-[N-(4-fluorobenzyl)carboxyamide]-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 2'-O-methyl-adenosine
  misc_feature (12)..(12): n is 2'-O-methyl-cytidine
  misc_feature (15)..(15): n is 2'-deoxyguanosine-3'-phosphorothioate
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 327 - DNA, 27 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (20)..(22): n is 5-(N-benzylcarboxyamide)-2'-deoxyuridine
  misc_feature (24)..(24): n is 5-(N-benzylcarboxyamide)-2'-deoxyuridine
nnacgacnacgnnacagcgnnnanagc

SEQ ID NO: 328 - DNA, 22 bp, Artificial Sequence
  Synthetic
  misc_feature (1)..(2): n is 5-(N-benzylcarboxyamide)-2'-deoxyuridine
  misc_feature (5)..(5): n is hexaethylene glycol
  misc_feature (7)..(8): n is 5-(N-benzylcarboxyamide)-2'-deoxyuridine
  misc_feature (15)..(17): n is 5-(N-benzylcarboxyamide)-2'-deoxyuridine
  misc_feature (19)..(19): n is 5-(N-benzylcarboxyamide)-2'-deoxyuridine
nnacngnnacagcgnnnanagc

SEQ ID NO: 329 - DNA, 22 bp, Artificial Sequence
  Synthetic
  misc_feature (1)..(2): n is 5-(N-benzylcarboxyamide)-2'-deoxyuridine
  misc_feature (5)..(5): n is hexaethylene glycol
  misc_feature (7)..(8): n is 5-(N-benzylcarboxyamide)-2'-deoxyuridine
  misc_feature (11)..(11): n is 1,3-propane diol
  misc_feature (15)..(17): n is 5-(N-benzylcarboxyamide)-2'-deoxyuridine
  misc_feature (19)..(19): n is 5-(N-benzylcarboxyamide)-2'-deoxyuridine
nnacngnnacngcgnnnanagc

SEQ ID NO: 330 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (15)..(15): n is 2'-O-methyl-guanosine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcnnnnnnngcn

SEQ ID NO: 331 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcnnnnnnngcn

SEQ ID NO: 332 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (15)..(15): n is 2'-O-methyl-guanosine
  misc_feature (16)..(16): n is 5-[N-(2-naphthylmethyl)carboxyamide]-2'-deoxyuridine
  misc_feature (17)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngcnnnnnnngcn

SEQ ID NO: 333 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (13)..(13): n is 2'-O-methyl-guanosine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnnncgnnnnnngcn

SEQ ID NO: 334 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (13)..(13): n is 2'-O-methyl-guanosine
  misc_feature (15)..(15): n is 2'-O-methyl-guanosine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnnncnnnnnnngcn

SEQ ID NO: 335 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (13)..(13): n is 2'-O-methyl-guanosine
  misc_feature (16)..(16): n is 5-[N-(1-naphthylmethyl)carboxyamide]-2'-deoxyuridine
  misc_feature (17)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnnncgnnnnnngcn

SEQ ID NO: 336 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (13)..(13): n is 2'-O-methyl-guanosine
  misc_feature (14)..(14): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnnnngnnnnnngcn

SEQ ID NO: 337 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (9)..(9): n is 2'-O-methyl-adenosine
  misc_feature (11)..(11): n is 1,3-propane diol
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcgnnnnnngcn

SEQ ID NO: 338 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 1,3-propane diol
  misc_feature (12)..(12): n is 2'-O-methyl-cytidine
  misc_feature (15)..(15): n is 2'-deoxyguanosine-3'-phosphorothioate
  misc_feature (16)..(16): n is 5-[N-(1-naphthylmethyl)carboxyamide]-2'-deoxyuridine
  misc_feature (17)..(17): n is 5-(N-benzylcarboxyamide)-2'-deoxyuridine-3'-phosphorothioate
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 339 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 1,3-propane diol
  misc_feature (12)..(12): n is 2'-O-methyl-cytidine
  misc_feature (15)..(15): n is 2'-deoxyguanosine-3'-phosphorothioate
  misc_feature (16)..(16): n is 5-(N-benzylcarboxyamide)-2'-deoxyuridine
  misc_feature (17)..(17): n is 5-(N-benzylcarboxyamide)-2'-deoxyuridine-3'-phosphorothioate
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 340 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 1,3-propane diol
  misc_feature (12)..(12): n is 2'-O-methyl-cytidine
  misc_feature (15)..(15): n is 2'-deoxyguanosine-3'-phosphorothioate
  misc_feature (16)..(16): n is 5-[N-(1-naphthylmethyl)carboxyamide]-2'-deoxyuridine
  misc_feature (17)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 341 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 1,3-propane diol
  misc_feature (12)..(12): n is 2'-O-methyl-cytidine
  misc_feature (15)..(15): n is 2'-deoxyguanosine-3'-phosphorothioate
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 342 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 1,3-propane diol
  misc_feature (12)..(12): n is 2'-O-methyl-cytidine
  misc_feature (15)..(15): n is 2'-deoxyguanosine-3'-phosphorothioate
  misc_feature (16)..(16): n is 5-[N-(1-naphthylmethyl)carboxyamide]-2'-deoxyuridine
  misc_feature (17)..(17): n is 5-(N-benzylcarboxyamide)-2'-deoxyuridine-3'-phosphorothioate
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 343 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 1,3-propane diol
  misc_feature (12)..(12): n is 2'-O-methyl-cytidine
  misc_feature (15)..(15): n is 2'-deoxyguanosine-3'-phosphorothioate
  misc_feature (16)..(16): n is 5-(N-benzylcarboxyamide)-2'-deoxyuridine
  misc_feature (17)..(17): n is 5-(N-benzylcarboxyamide)-2'-deoxyuridine-3'-phosphorothioate
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 344 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (9)..(9): n is 2'-deoxyadenosine-3'-phosphorothioate
  misc_feature (11)..(11): n is 1,3-propane diol
  misc_feature (12)..(12): n is 2'-O-methyl-cytidine
  misc_feature (15)..(15): n is 2'-deoxyguanosine-3'-phosphorothioate
  misc_feature (16)..(16): n is 5-[N-(1-naphthylmethyl)carboxyamide]-2'-deoxyuridine
  misc_feature (17)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 345 - DNA, 42 bp, Artificial Sequence
  Synthetic
  misc_feature (5)..(5): n is 5-(N-benzylcarboxyamide)-2'-deoxyuridine
  misc_feature (9)..(10): n is 5-(N-benzylcarboxyamide)-2'-deoxyuridine
  misc_feature (18)..(20): n is 5-(N-benzylcarboxyamide)-2'-deoxyuridine
  misc_feature (22)..(22): n is 5-(N-benzylcarboxyamide)-2'-deoxyuridine
  misc_feature (27)..(27): n is 5-(N-benzylcarboxyamide)-2'-deoxyuridine
  misc_feature (37)..(37): n is 5-(N-benzylcarboxyamide)-2'-deoxyuridine
cgacnacgnnacacgcgnnnanagcgncaacccgagngaaca

SEQ ID NO: 346 - DNA, 40 bp, Artificial Sequence
  Synthetic
  misc_feature (3)..(3): n is 5-(N-benzylcarboxyamide)-2'-deoxyuridine
  misc_feature (7)..(8): n is 5-(N-benzylcarboxyamide)-2'-deoxyuridine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (25)..(25): n is 5-(N-benzylcarboxyamide)-2'-deoxyuridine
  misc_feature (35)..(35): n is 5-(N-benzylcarboxyamide)-2'-deoxyuridine
acnacgnnacacgcgnnnanagcgncaacccgagngaaca

SEQ ID NO: 347 - DNA, 38 bp, Artificial Sequence
  Synthetic
  misc_feature (1)..(1): n is 5-(N-benzylcarboxyamide)-2'-deoxyuridine
  misc_feature (5)..(6): n is 5-(N-benzylcarboxyamide)-2'-deoxyuridine
  misc_feature (14)..(16): n is 5-(N-benzylcarboxyamide)-2'-deoxyuridine
  misc_feature (18)..(18): n is 5-(N-benzylcarboxyamide)-2'-deoxyuridine
  misc_feature (23)..(23): n is 5-(N-benzylcarboxyamide)-2'-deoxyuridine
  misc_feature (33)..(33): n is 5-(N-benzylcarboxyamide)-2'-deoxyuridine
nacgnnacacgcgnnnanagcgncaacccgagngaaca

SEQ ID NO: 348 - DNA, 36 bp, Artificial Sequence
  Synthetic
  misc_feature (3)..(4): n is 5-(N-benzylcarboxyamide)-2'-deoxyuridine
  misc_feature (12)..(14): n is 5-(N-benzylcarboxyamide)-2'-deoxyuridine
  misc_feature (16)..(16): n is 5-(N-benzylcarboxyamide)-2'-deoxyuridine
  misc_feature (21)..(21): n is 5-(N-benzylcarboxyamide)-2'-deoxyuridine
  misc_feature (31)..(31): n is 5-(N-benzylcarboxyamide)-2'-deoxyuridine
cgnnacacgcgnnnanagcgncaacccgagngaaca

SEQ ID NO: 349 - DNA, 34 bp, Artificial Sequence
  Synthetic
  misc_feature (1)..(2): n is 5-(N-benzylcarboxyamide)-2'-deoxyuridine
  misc_feature (10)..(12): n is 5-(N-benzylcarboxyamide)-2'-deoxyuridine
  misc_feature (14)..(14): n is 5-(N-benzylcarboxyamide)-2'-deoxyuridine
  misc_feature (19)..(19): n is 5-(N-benzylcarboxyamide)-2'-deoxyuridine
  misc_feature (29)..(29): n is 5-(N-benzylcarboxyamide)-2'-deoxyuridine
nnacacgcgnnnanagcgncaacccgagngaaca

SEQ ID NO: 350 - DNA, 32 bp, Artificial Sequence
  Synthetic
  misc_feature (8)..(10): n is 5-(N-benzylcarboxyamide)-2'-deoxyuridine
  misc_feature (12)..(12): n is 5-(N-benzylcarboxyamide)-2'-deoxyuridine
  misc_feature (17)..(17): n is 5-(N-benzylcarboxyamide)-2'-deoxyuridine
  misc_feature (27)..(27): n is 5-(N-benzylcarboxyamide)-2'-deoxyuridine
acacgcgnnnanagcgncaacccgagngaaca

SEQ ID NO: 351 - DNA, 27 bp, Artificial Sequence
  Synthetic
  misc_feature (2)..(3): n is 5-(N-benzylcarboxyamide)-2'-deoxyuridine
  misc_feature (9)..(9): n is 5-(N-benzylcarboxyamide)-2'-deoxyuridine
  misc_feature (13)..(14): n is 5-(N-benzylcarboxyamide)-2'-deoxyuridine
  misc_feature (22)..(24): n is 5-(N-benzylcarboxyamide)-2'-deoxyuridine
  misc_feature (26)..(26): n is 5-(N-benzylcarboxyamide)-2'-deoxyuridine
cnnacgacnacgnnacacgcgnnnana

SEQ ID NO: 352 - DNA, 26 bp, Artificial Sequence
  Synthetic
  misc_feature (2)..(3): n is 5-(N-benzylcarboxyamide)-2'-deoxyuridine
  misc_feature (9)..(9): n is 5-(N-benzylcarboxyamide)-2'-deoxyuridine
  misc_feature (13)..(14): n is 5-(N-benzylcarboxyamide)-2'-deoxyuridine
  misc_feature (22)..(24): n is 5-(N-benzylcarboxyamide)-2'-deoxyuridine
cnnacgacnacgnnacacgcgnnnat

SEQ ID NO: 353 - DNA, 25 bp, Artificial Sequence
  Synthetic
  misc_feature (2)..(3): n is 5-(N-benzylcarboxyamide)-2'-deoxyuridine
  misc_feature (9)..(9): n is 5-(N-benzylcarboxyamide)-2'-deoxyuridine
  misc_feature (13)..(14): n is 5-(N-benzylcarboxyamide)-2'-deoxyuridine
  misc_feature (22)..(24): n is 5-(N-benzylcarboxyamide)-2'-deoxyuridine
cnnacgacnacgnnacacgcgnnna

SEQ ID NO: 354 - DNA, 26 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnana

SEQ ID NO: 355 - DNA, 25 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
nnacgacnacgnnacacgcgnnnat

SEQ ID NO: 356 - DNA, 24 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
nnacgacnacgnnacacgcgnnna

SEQ ID NO: 357 - DNA, 29 bp, Artificial Sequence
  Synthetic
  misc_feature (1)..(1): n is 5-(N-benzylcarboxyamide)-2'-deoxyuridine
  misc_feature (2)..(2): n is 1,3-propane diol
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 358 - DNA, 29 bp, Artificial Sequence
  Synthetic
  misc_feature (1)..(2): n is 5-(N-benzylcarboxyamide)-2'-deoxyuridine
  misc_feature (3)..(3): n is 1,3-propane diol
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnncgacnacgnnacacgcgnnnanagcg

SEQ ID NO: 359 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (11)..(11): n is 1,3-propane diol
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacnnnacacgcgnnnanagcg

SEQ ID NO: 360 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(12): n is 1,3-propane diol
  misc_feature (13)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 361 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(12): n is 5-(N-benzylcarboxyamide)-2'-deoxyuridine
  misc_feature (13)..(13): n is 1,3-propane diol
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 362 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (14)..(14): n is 1,3-propane diol
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnncacgcgnnnanagcg

SEQ ID NO: 363 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (18)..(18): n is 1,3-propane diol
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacncgnnnanagcg

SEQ ID NO: 364 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (19)..(19): n is 1,3-propane diol
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgngnnnanagcg

SEQ ID NO: 365 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (20)..(20): n is 1,3-propane diol
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcnnnnanagcg

SEQ ID NO: 366 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(21): n is 1,3-propane diol
  misc_feature (22)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 367 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(21): n is 5-(N-benzylcarboxyamide)-2'-deoxyuridine
  misc_feature (22)..(22): n is 1,3-propane diol
  misc_feature (23)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 368 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(22): n is 5-(N-benzylcarboxyamide)-2'-deoxyuridine
  misc_feature (23)..(23): n is 1,3-propane diol
  misc_feature (25)..(25): n is 5-(N-benzylcarboxyamide)-2'-deoxyuridine
nnacgacnacgnnacacgcgnnnanagcg

SEQ ID NO: 369 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 1,3-propane diol
nnacgacnacgnnacacgcgnnnanagcg

SEQ ID NO: 370 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
  misc_feature (26)..(26): n is 1,3-propane diol
nnacgacnacgnnacacgcgnnnanngcg

SEQ ID NO: 371 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
  misc_feature (27)..(27): n is 1,3-propane diol
nnacgacnacgnnacacgcgnnnanancg

SEQ ID NO: 372 - DNA, 29 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (6)..(6): n is 1,3-propane diol
  misc_feature (8)..(8): n is 1,3-propane diol
  misc_feature (9)..(9): n is 1,3-propane diol
  misc_feature (12)..(13): n is 5-(N-benzylcarboxyamide)-2'-deoxyuridine
  misc_feature (16)..(16): n is 2'-O-methyl-adenosine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
  misc_feature (26)..(26): n is 2'-O-methyl-adenosine
  misc_feature (29)..(29): n is 2'-O-methyl-guanosine
nnncgncnncgnnacncgcgnnnanngcn

SEQ ID NO: 373 - DNA, 29 bp, Artificial Sequence
  Synthetic
  misc_feature (1)..(1): n is 5-(N-benzylcarboxyamide)-2'-deoxyuridine
  misc_feature (2)..(2): n is 2'-O-methyl-uridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 374 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(12): n is 5-(N-benzylcarboxyamide)-2'-deoxyuridine
  misc_feature (13)..(13): n is 2'-O-methyl-uridine
  misc_feature (21)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 375 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(21): n is 2'-O-methyl-uridine
  misc_feature (22)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 376 - DNA, 29 bp, Artificial Sequence
  Synthetic
  misc_feature (1)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(21): n is 5-(N-benzylcarboxyamide)-2'-deoxyuridine
  misc_feature (22)..(22): n is 2'-O-methyl-uridine
  misc_feature (23)..(23): n is 5-(N-benzylcarboxyamide)-2'-deoxyuridine
  misc_feature (25)..(25): n is 5-(N-benzylcarboxyamide)-2'-deoxyuridine
nnacgacnacgnnacacgcgnnnanagcg

SEQ ID NO: 377 - DNA, 29 bp, Artificial Sequence
  Synthetic
  misc_feature (1)..(1): n is 5-[N-(1-naphthylmethyl)carboxyamide]-2'-deoxyuridine
  misc_feature (2)..(2): n is 5-(N-benzylcarboxyamide)-2'-deoxyuridine
  misc_feature (8)..(8): n is 5-(N-benzylcarboxyamide)-2'-deoxyuridine
  misc_feature (12)..(13): n is 5-(N-benzylcarboxyamide)-2'-deoxyuridine
  misc_feature (21)..(23): n is 5-(N-benzylcarboxyamide)-2'-deoxyuridine
  misc_feature (25)..(25): n is 2'-O-methyl-uridine
nnacgacnacgnnacacgcgnnnanagcg

SEQ ID NO: 378 - DNA, 25 bp, Artificial Sequence
  Synthetic
  misc_feature (1)..(1): n is 5-(N-benzylcarboxyamide)-2'-deoxyuridine
  misc_feature (2)..(2): n is 5-[N-(1-naphthylmethyl)carboxyamide]-2'-deoxyuridine
  misc_feature (5)..(6): n is hexaethylene glycol
  misc_feature (8)..(8): n is 2'-O-methyl-uridine
  misc_feature (9)..(9): n is 5-[N-(1-naphthylmethyl)carboxyamide]-2'-deoxyuridine
  misc_feature (17)..(18): n is 5-[N-(1-naphthylmethyl)carboxyamide]-2'-deoxyuridine
  misc_feature (19)..(19): n is 5-(N-benzylcarboxyamide)-2'-deoxyuridine
  misc_feature (21)..(21): n is 5-[N-(1-naphthylmethyl)carboxyamide]-2'-deoxyuridine
nnacnngnnacacgcgnnnanagcg

SEQ ID NO: 379 - DNA, 25 bp, Artificial Sequence
  Synthetic
  misc_feature (1)..(1): n is 5-(N-benzylcarboxyamide)-2'-deoxyuridine
  misc_feature (2)..(2): n is 5-[N-(1-naphthylmethyl)carboxyamide]-2'-deoxyuridine
  misc_feature (3)..(3): n is 2'-O-methyl-adenosine
  misc_feature (5)..(6): n is hexaethylene glycol
  misc_feature (8)..(8): n is 2'-O-methyl-uridine
  misc_feature (9)..(9): n is 5-[N-(1-naphthylmethyl)carboxyamide]-2'-deoxyuridine
  misc_feature (12)..(12): n is 2'-O-methyl-adenosine
  misc_feature (17)..(18): n is 5-[N-(1-naphthylmethyl)carboxyamide]-2'-deoxyuridine
  misc_feature (19)..(19): n is 5-(N-benzylcarboxyamide)-2'-deoxyuridine
  misc_feature (21)..(21): n is 5-[N-(1-naphthylmethyl)carboxyamide]-2'-deoxyuridine
  misc_feature (22)..(22): n is 2'-O-methyl-adenosine
  misc_feature (25)..(25): n is 2'-O-methyl-guanosine
nnncnngnnacncgcgnnnanngcn

SEQ ID NO: 380 - DNA, 23 bp, Artificial Sequence
  Synthetic
  misc_feature (1)..(2): n is 5-(N-benzylcarboxyamide)-2'-deoxyuridine
  misc_feature (6)..(7): n is 5-(N-benzylcarboxyamide)-2'-deoxyuridine
  misc_feature (15)..(17): n is 5-(N-benzylcarboxyamide)-2'-deoxyuridine
  misc_feature (19)..(19): n is 5-(N-benzylcarboxyamide)-2'-deoxyuridine
nnacgnnacacgcgnnnanagcg

SEQ ID NO: 381 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-(3-indole-2-ethyl)-carboxyamide]-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 382 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-[N-(3-indole-2-ethyl)-carboxyamide]-2'-deoxyuridine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 383 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(3-indole-2-ethyl)-carboxyamide]-2'-deoxyuridine
  misc_feature (18)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 384 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-(2-naphthylmethyl)carboxyamide]-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 385 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(2-naphthyl-2-ethyl)carboxyamide]-2'-deoxyuridine
  misc_feature (18)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 386 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (9)..(9): n is 2'-O-methyl-adenosine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncncgcgnnnanngcn

SEQ ID NO: 387 - DNA, 24 bp, Artificial Sequence
  Synthetic
  misc_feature (1)..(1): n is 5-[N-(4-hydroxyphenyl-2-ethyl)carboxyamide]-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-[N-(4-fluorobenzyl)carboxyamide]-2'-deoxyuridine
  misc_feature (8)..(8): n is 5-[N-isobutyl-carboxyamide]-2'-deoxyuridine
  misc_feature (11)..(11): n is 2'-O-methyl-adenosine
  misc_feature (16)..(16): n is 5-[N-(2-naphthylmethyl)carboxyamide]-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-[N-(1-naphthyl-2-ethyl)carboxyamide]-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 388 - DNA, 24 bp, Artificial Sequence
  Synthetic
  misc_feature (1)..(1): n is 5-[N-(4-hydroxyphenyl-2-ethyl)carboxyamide]-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-[N-(4-fluorobenzyl)carboxyamide]-2'-deoxyuridine
  misc_feature (8)..(8): n is 5-[N-isobutyl-carboxyamide]-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-[N-(2-naphthylmethyl)carboxyamide]-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (19)..(19): n is 2'-O-methyl-adenosine
  misc_feature (20)..(20): n is 5-[N-(1-naphthyl-2-ethyl)carboxyamide]-2'-deoxyuridine
  misc_feature (21)..(21): n is 2'-O-methyl-adenosine
  misc_feature (22)..(22): n is 2'-O-methyl-guanosine
  misc_feature (24)..(24): n is 2'-O-methyl-guanosine
nnncngnnacnngcgnnnnnnncn

SEQ ID NO: 389 - DNA, 24 bp, Artificial Sequence
  Synthetic
  misc_feature (1)..(1): n is 5-[N-(3-indole-2-ethyl)-carboxyamide]-2'-deoxyuridine
  misc_feature (2)..(2): n is 5-[N-isobutyl-carboxyamide]-2'-deoxyuridine
  misc_feature (3)..(3): n is 2'-O-methyl-adenosine
  misc_feature (5)..(5): n is hexaethylene glycol
  misc_feature (7)..(7): n is 5-[N-(1-naphthyl-2-ethyl)carboxyamide]-2'-deoxyuridine
  misc_feature (8)..(8): n is 5-[N-isobutyl-carboxyamide]-2'-deoxyuridine
  misc_feature (11)..(11): n is 2'-O-methyl-adenosine
  misc_feature (16)..(16): n is 5-[N-(2-thiophene-methyl)carboxyamide]-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-[N-(3,4-methylenedioxyphenyl-methyl)carboxyamide]-2'-deoxyuridi ne
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 390 - DNA, 24 bp, Artificial Sequence
  Synthetic
  misc_feature (1)..(1): n is 5-[N-(3-indole-2-ethyl)-carboxyamide]-2'-deoxyuridine
  misc_feature (2)..(2): n is 5-[N-isobutyl-carboxyamide]-2'-deoxyuridine
  misc_feature (3)..(3): n is 2'-O-methyl-adenosine
  misc_feature (5)..(5): n is hexaethylene glycol
  misc_feature (7)..(7): n is 5-[N-(1-naphthyl-2-ethyl)carboxyamide]-2'-deoxyuridine
  misc_feature (8)..(8): n is 5-[N-isobutyl-carboxyamide]-2'-deoxyuridine
  misc_feature (11)..(11): n is 2'-O-methyl-adenosine
  misc_feature (12)..(12): n is 2'-O-methyl-cytidine
  misc_feature (16)..(16): n is 5-[N-(2-thiophene-methyl)carboxyamide]-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (19)..(19): n is 2'-O-methyl-adenosine
  misc_feature (20)..(20): n is 5-[N-(3,4-methylenedioxyphenyl-methyl)carboxyamide]-2'-deoxyuridi ne
  misc_feature (21)..(21): n is 2'-O-methyl-adenosine
  misc_feature (22)..(22): n is 2'-O-methyl-guanosine
  misc_feature (24)..(24): n is 2'-O-methyl-guanosine
nnncngnnacnngcgnnnnnnncn

SEQ ID NO: 391 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 2'-O-methyl-uridine
  misc_feature (8)..(8): n is 5-[N-isobutyl-carboxyamide]-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 392 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-(4-fluorobenzyl)carboxyamide]-2'-deoxyuridine
  misc_feature (8)..(8): n is 5-[N-isobutyl-carboxyamide]-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 393 - DNA, 24 bp, Artificial Sequence
  Synthetic
  misc_feature (1)..(1): n is 5-[N-(4-hydroxyphenyl-2-ethyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (8)..(8): n is 5-[N-isobutyl-carboxyamide]-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 394 - DNA, 24 bp, Artificial Sequence
  Synthetic
  misc_feature (1)..(1): n is 5-[N-(4-hydroxyphenyl-2-ethyl)carboxyamide]-2'-deoxyuridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-[N-(4-fluorobenzyl)carboxyamide]-2'-deoxyuridine
  misc_feature (8)..(8): n is 5-[N-isobutyl-carboxyamide]-2'-deoxyuridine
  misc_feature (11)..(11): n is 2'-O-methyl-adenosine
  misc_feature (16)..(16): n is 5-[N-(2-naphthylmethyl)carboxyamide]-2'-deoxyuridine
  misc_feature (17)..(17): n is 5-[N-(phenyl-2-ethyl)-carboxyamide]-2'-deoxyuridine
  misc_feature (18)..(18): n is 5-[N-(2-thiophene-methyl)carboxyamide]-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 395 - DNA, 23 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is 1,3-propane diol
  misc_feature (7)..(8): n is 5-(N-benzylcarboxyamide)-2'-deoxyuridine
  misc_feature (11)..(11): n is 1,3-propane diol
  misc_feature (15)..(17): n is 5-(N-benzylcarboxyamide)-2'-deoxyuridine
  misc_feature (19)..(19): n is 5-(N-benzylcarboxyamide)-2'-deoxyuridine
  misc_feature (20)..(20): n is 2'-O-methyl-adenosine
  misc_feature (23)..(23): n is 2'-O-methyl-guanosine
nnncngnnacngcgnnnanngcn

SEQ ID NO: 396 - DNA, 24 bp, Artificial Sequence
  Synthetic
  misc_feature (1)..(1): n is 5-(N-benzylcarboxyamide)-2'-O-methyl-uridine
  misc_feature (2)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 397 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-(N-benzylcarboxyamide)-2'-O-methyl-uridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 398 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-O-methyl-uridine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 399 - DNA, 24 bp, Artificial Sequence
  Synthetic
  misc_feature (1)..(2): n is5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is5-(N-benzylcarboxyamide)-2'-deoxyuridine
  misc_feature (11)..(11): n is 2'-O-methyl-adenosine
  misc_feature (16)..(16): n is5-(N-benzylcarboxyamide)-2'-deoxyuridine
  misc_feature (17)..(17): n is 5-(N-benzylcarboxyamide)-2'-O-methyl-uridine
  misc_feature (18)..(18): n is5-(N-benzylcarboxyamide)-2'-deoxyuridine
  misc_feature (20)..(20): n is5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnanngcn

SEQ ID NO: 400 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (9)..(9): n is 2'-fluoro-2'-deoxyadenosine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcgnnnnnngcn

SEQ ID NO: 401 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (10)..(10): n is 2'-fluoro-2'-deoxycytidine
  misc_feature (11)..(11): n is 2'-O-methyl-adenosine
  misc_feature (12)..(12): n is 2'-O-methyl-cytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnannngcgnnnnnngcn

SEQ ID NO: 402 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (14)..(14): n is 2'-fluoro-2'-deoxycytidine
  misc_feature (16)..(16): n is 5-(N-benzylcarboxyamide)-2'-deoxyuridine
  misc_feature (17)..(17): n is 5-[N-(phenyl-2-ethyl)-carboxyamide]-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacnngngnnnnnngcn

SEQ ID NO: 403 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngntacncgcgnnnanngcn

SEQ ID NO: 404 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (17)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgtnnanngcn

SEQ ID NO: 405 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(16): n is 5-(N-benzylcarboxyamide)-2'-deoxyuridine
  misc_feature (18)..(18): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgntnanngcn

SEQ ID NO: 406 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(17): n is 5-(N-benzylcarboxyamide)-2'-deoxyuridine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnntanngcn

SEQ ID NO: 407 - DNA, 24 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (16)..(18): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnacncgcgnnnatngcn

SEQ ID NO: 408 - DNA, 20 bp, Artificial Sequence
  Synthetic
  misc_feature (1)..(2): n is 5-(N-benzylcarboxyamide)-2'-deoxyuridine
  misc_feature (5)..(5): n is hexaethylene glycol
  misc_feature (7)..(8): n is 5-(N-benzylcarboxyamide)-2'-deoxyuridine
  misc_feature (11)..(11): n is 1,3-propane diol
  misc_feature (14)..(16): n is 5-(N-benzylcarboxyamide)-2'-deoxyuridine
  misc_feature (18)..(18): n is 5-(N-benzylcarboxyamide)-2'-deoxyuridine
nnacngnnacncgnnnanag

SEQ ID NO: 409 - DNA, 24 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (9)..(9): n is 2'-O-methyl-adenosine
  misc_feature (11)..(11): n is 1,3-propane diol
  misc_feature (12)..(12): n is 2'-O-methyl-cytidine
  misc_feature (15)..(15): n is 2'-O-methyl-guanosine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
nnncngnnncnngcnnnnnnngcn

SEQ ID NO: 410 - DNA, 50 bp, Artificial Sequence
  Synthetic
  misc_feature (6)..(6): n is 5-[N-(1-naphthylmethyl)carboxyamide]-2'-deoxyuridine
  misc_feature (15)..(15): n is 5-[N-(1-naphthylmethyl)carboxyamide]-2'-deoxyuridine
  misc_feature (17)..(17): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (25)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (34)..(34): n is 5-[N-(1-naphthylmethyl)carboxyamide]-2'-deoxyuridine
  misc_feature (41)..(41): n is 5-[N-(1-naphthylmethyl)carboxyamide]-2'-deoxyuridine
  misc_feature (45)..(45): n is 5-[N-(1-naphthylmethyl)carboxyamide]-2'-deoxyuridine
ctgccncgacagcangnangcacancnagaggcnacccagngaangagga

SEQ ID NO: 411 - DNA, 47 bp, Artificial Sequence
  Synthetic
  misc_feature (3)..(3): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (14)..(14): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (22)..(22): n is 5-[N-(1-naphthylmethyl)carboxyamide]-2'-deoxyuridine
  misc_feature (24)..(24): n is 5-[N-(1-naphthylmethyl)carboxyamide]-2'-deoxyuridine
  misc_feature (31)..(31): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (42)..(42): n is 5-[N-(1-naphthylmethyl)carboxyamide]-2'-deoxyuridine
ccncgacagcangnangcacancnagaggcnacccagngaangagga

SEQ ID NO: 412 - DNA, 44 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (28)..(28): n is 5-[N-(1-naphthylmethyl)carboxyamide]-2'-deoxyuridine
  misc_feature (35)..(35): n is 5-[N-(1-naphthylmethyl)carboxyamide]-2'-deoxyuridine
  misc_feature (39)..(39): n is 5-[N-(1-naphthylmethyl)carboxyamide]-2'-deoxyuridine
cgacagcangnangcacancnagaggcnacccagngaangagga

SEQ ID NO: 413 - DNA, 41 bp, Artificial Sequence
  Synthetic
  misc_feature (6)..(6): n is 5-[N-(1-naphthylmethyl)carboxyamide]-2'-deoxyuridine
  misc_feature (8)..(8): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (25)..(25): n is 5-[N-(1-naphthylmethyl)carboxyamide]-2'-deoxyuridine
  misc_feature (32)..(32): n is 5-[N-(1-naphthylmethyl)carboxyamide]-2'-deoxyuridine
  misc_feature (36)..(36): n is 5-[N-(1-naphthylmethyl)carboxyamide]-2'-deoxyuridine
cagcangnangcacancnagaggcnacccagngaangagga

SEQ ID NO: 414 - DNA, 47 bp, Artificial Sequence
  Synthetic
  misc_feature (6)..(6): n is 5-[N-(1-naphthylmethyl)carboxyamide]-2'-deoxyuridine
  misc_feature (15)..(15): n is 5-[N-(1-naphthylmethyl)carboxyamide]-2'-deoxyuridine
  misc_feature (17)..(17): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (25)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (34)..(34): n is 5-[N-(1-naphthylmethyl)carboxyamide]-2'-deoxyuridine
  misc_feature (41)..(41): n is 5-[N-(1-naphthylmethyl)carboxyamide]-2'-deoxyuridine
  misc_feature (45)..(45): n is 5-[N-(1-naphthylmethyl)carboxyamide]-2'-deoxyuridine
ctgccncgacagcangnangcacancnagaggcnacccagngaanga

SEQ ID NO: 415 - DNA, 44 bp, Artificial Sequence
  Synthetic
  misc_feature (6)..(6): n is 5-[N-(1-naphthylmethyl)carboxyamide]-2'-deoxyuridine
  misc_feature (15)..(15): n is 5-[N-(1-naphthylmethyl)carboxyamide]-2'-deoxyuridine
  misc_feature (17)..(17): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (25)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (34)..(34): n is 5-[N-(1-naphthylmethyl)carboxyamide]-2'-deoxyuridine
  misc_feature (41)..(41): n is 5-[N-(1-naphthylmethyl)carboxyamide]-2'-deoxyuridine
ctgccncgacagcangnangcacancnagaggcnacccagngaa

SEQ ID NO: 416 - DNA, 41 bp, Artificial Sequence
  Synthetic
  misc_feature (6)..(6): n is 5-[N-(1-naphthylmethyl)carboxyamide]-2'-deoxyuridine
  misc_feature (15)..(15): n is 5-[N-(1-naphthylmethyl)carboxyamide]-2'-deoxyuridine
  misc_feature (17)..(17): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (25)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (34)..(34): n is 5-[N-(1-naphthylmethyl)carboxyamide]-2'-deoxyuridine
  misc_feature (41)..(41): n is 5-[N-(1-naphthylmethyl)carboxyamide]-2'-deoxyuridine
ctgccncgacagcangnangcacancnagaggcnacccagn

SEQ ID NO: 417 - DNA, 38 bp, Artificial Sequence
  Synthetic
  misc_feature (6)..(6): n is 5-[N-(1-naphthylmethyl)carboxyamide]-2'-deoxyuridine
  misc_feature (15)..(15): n is 5-[N-(1-naphthylmethyl)carboxyamide]-2'-deoxyuridine
  misc_feature (17)..(17): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (25)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (34)..(34): n is 5-[N-(1-naphthylmethyl)carboxyamide]-2'-deoxyuridine
ctgccncgacagcangnangcacancnagaggcnaccc

SEQ ID NO: 418 - DNA, 35 bp, Artificial Sequence
  Synthetic
  misc_feature (6)..(6): n is 5-[N-(1-naphthylmethyl)carboxyamide]-2'-deoxyuridine
  misc_feature (15)..(15): n is 5-[N-(1-naphthylmethyl)carboxyamide]-2'-deoxyuridine
  misc_feature (17)..(17): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (25)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (34)..(34): n is 5-[N-(1-naphthylmethyl)carboxyamide]-2'-deoxyuridine
ctgccncgacagcangnangcacancnagaggcna

SEQ ID NO: 419 - DNA, 38 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (28)..(28): n is 5-[N-(1-naphthylmethyl)carboxyamide]-2'-deoxyuridine
  misc_feature (35)..(35): n is 5-[N-(1-naphthylmethyl)carboxyamide]-2'-deoxyuridine
cgacagcangnangcacancnagaggcnacccagngaa

SEQ ID NO: 420 - DNA, 37 bp, Artificial Sequence
  Synthetic
  misc_feature (8)..(8): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (20)..(20): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (34)..(34): n is 5-[N-(1-naphthylmethyl)carboxyamide]-2'-deoxyuridine
gacagcangnangcacancnagaggcnacccagngaa

SEQ ID NO: 421 - DNA, 36 bp, Artificial Sequence
  Synthetic
  misc_feature (7)..(7): n is 5-[N-(1-naphthylmethyl)carboxyamide]-2'-deoxyuridine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (17)..(17): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (26)..(26): n is 5-[N-(1-naphthylmethyl)carboxyamide]-2'-deoxyuridine
  misc_feature (33)..(33): n is 5-[N-(1-naphthylmethyl)carboxyamide]-2'-deoxyuridine
acagcangnangcacancnagaggcnacccagngaa

SEQ ID NO: 422 - DNA, 37 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (28)..(28): n is 5-[N-(1-naphthylmethyl)carboxyamide]-2'-deoxyuridine
  misc_feature (35)..(35): n is 5-[N-(1-naphthylmethyl)carboxyamide]-2'-deoxyuridine
cgacagcangnangcacancnagaggcnacccagnga

SEQ ID NO: 423 - DNA, 36 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (28)..(28): n is 5-[N-(1-naphthylmethyl)carboxyamide]-2'-deoxyuridine
  misc_feature (35)..(35): n is 5-[N-(1-naphthylmethyl)carboxyamide]-2'-deoxyuridine
cgacagcangnangcacancnagaggcnacccagng

SEQ ID NO: 424 - DNA, 35 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (28)..(28): n is 5-[N-(1-naphthylmethyl)carboxyamide]-2'-deoxyuridine
  misc_feature (35)..(35): n is 5-[N-(1-naphthylmethyl)carboxyamide]-2'-deoxyuridine
cgacagcangnangcacancnagaggcnacccagn

SEQ ID NO: 425 - DNA, 29 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (28)..(28): n is 5-[N-(1-naphthylmethyl)carboxyamide]-2'-deoxyuridine
cgacagcangnangcacancnagaggcna

SEQ ID NO: 426 - DNA, 28 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (28)..(28): n is 5-[N-(1-naphthylmethyl)carboxyamide]-2'-deoxyuridine
cgacagcangnangcacancnagaggcn

SEQ ID NO: 427 - DNA, 27 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcacancnagaggc

SEQ ID NO: 428 - DNA, 26 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcacancnagagg

SEQ ID NO: 429 - DNA, 25 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcacancnagag

SEQ ID NO: 430 - DNA, 24 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcacancnaga

SEQ ID NO: 431 - DNA, 23 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcacancnag

SEQ ID NO: 432 - DNA, 22 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcacancna

SEQ ID NO: 433 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcacancn

SEQ ID NO: 434 - DNA, 23 bp, Artificial Sequence
  Synthetic
  misc_feature (8)..(8): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (20)..(20): n is 5-[N-(1-naphthylmethyl)carboxyamide]-2'-deoxyuridine
gacagcangnangcacancnaga

SEQ ID NO: 435 - DNA, 22 bp, Artificial Sequence
  Synthetic
  misc_feature (8)..(8): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (20)..(20): n is 5-[N-(1-naphthylmethyl)carboxyamide]-2'-deoxyuridine
gacagcangnangcacancnag

SEQ ID NO: 436 - DNA, 21 bp, Artificial Sequence
  Synthetic
  misc_feature (8)..(8): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (20)..(20): n is 5-[N-(1-naphthylmethyl)carboxyamide]-2'-deoxyuridine
gacagcangnangcacancna

SEQ ID NO: 437 - DNA, 20 bp, Artificial Sequence
  Synthetic
  misc_feature (8)..(8): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (20)..(20): n is 5-[N-(1-naphthylmethyl)carboxyamide]-2'-deoxyuridine
gacagcangnangcacancn

SEQ ID NO: 438 - DNA, 24 bp, Artificial Sequence
  Synthetic
  misc_feature (8)..(8): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (20)..(20): n is 5-[N-(1-naphthylmethyl)carboxyamide]-2'-deoxyuridine
gacagcangnangcacancnagag

SEQ ID NO: 439 - DNA, 21 bp, Artificial Sequence
  Synthetic
  misc_feature (1)..(1): n is 1,3-propane diol
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
ngacagcangnangcacancn

SEQ ID NO: 440 - DNA, 21 bp, Artificial Sequence
  Synthetic
  misc_feature (2)..(2): n is 1,3-propane diol
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cnacagcangnangcacancn

SEQ ID NO: 441 - DNA, 21 bp, Artificial Sequence
  Synthetic
  misc_feature (3)..(3): n is 1,3-propane diol
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgncagcangnangcacancn

SEQ ID NO: 442 - DNA, 21 bp, Artificial Sequence
  Synthetic
  misc_feature (4)..(4): n is 1,3-propane diol
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cganagcangnangcacancn

SEQ ID NO: 443 - DNA, 21 bp, Artificial Sequence
  Synthetic
  misc_feature (5)..(5): n is 1,3-propane diol
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacngcangnangcacancn

SEQ ID NO: 444 - DNA, 21 bp, Artificial Sequence
  Synthetic
  misc_feature (6)..(6): n is 1,3-propane diol
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacancangnangcacancn

SEQ ID NO: 445 - DNA, 21 bp, Artificial Sequence
  Synthetic
  misc_feature (7)..(7): n is 1,3-propane diol
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagnangnangcacancn

SEQ ID NO: 446 - DNA, 21 bp, Artificial Sequence
  Synthetic
  misc_feature (8)..(8): n is 1,3-propane diol
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcnngnangcacancn

SEQ ID NO: 447 - DNA, 21 bp, Artificial Sequence
  Synthetic
  misc_feature (9)..(9): n is 1,3-propane diol
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcacancn

SEQ ID NO: 448 - DNA, 21 bp, Artificial Sequence
  Synthetic
  misc_feature (9)..(9): n is 5-[N-(1-naphthylmethyl)carboxyamide]-2'-deoxyuridine
  misc_feature (10)..(10): n is 1,3-propane diol
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcannnangcacancn

SEQ ID NO: 449 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 1,3-propane diol
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcacancn

SEQ ID NO: 450 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (12)..(12): n is 1,3-propane diol
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnnngcacancn

SEQ ID NO: 451 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 1,3-propane diol
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcacancn

SEQ ID NO: 452 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (14)..(14): n is 1,3-propane diol
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnanncacancn

SEQ ID NO: 453 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (15)..(15): n is 1,3-propane diol
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangnacancn

SEQ ID NO: 454 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (16)..(16): n is 1,3-propane diol
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcncancn

SEQ ID NO: 455 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (17)..(17): n is 1,3-propane diol
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcanancn

SEQ ID NO: 456 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (18)..(18): n is 1,3-propane diol
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcacnncn

SEQ ID NO: 457 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 1,3-propane diol
  misc_feature (21)..(21): n is 5-[N-(1-naphthylmethyl)carboxyamide]-2'-deoxyuridine
cgacagcangnangcacancn

SEQ ID NO: 458 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (20)..(20): n is 1,3-propane diol
  misc_feature (21)..(21): n is 5-[N-(1-naphthylmethyl)carboxyamide]-2'-deoxyuridine
cgacagcangnangcacannn

SEQ ID NO: 459 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 1,3-propane diol
cgacagcangnangcacancn

SEQ ID NO: 460 - DNA, 21 bp, Artificial Sequence
  Synthetic
  misc_feature (1)..(1): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
ngacagcangnangcacancn

SEQ ID NO: 461 - DNA, 21 bp, Artificial Sequence
  Synthetic
  misc_feature (4)..(4): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cganagcangnangcacancn

SEQ ID NO: 462 - DNA, 21 bp, Artificial Sequence
  Synthetic
  misc_feature (7)..(7): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagnangnangcacancn

SEQ ID NO: 463 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (15)..(15): n is 2'-O-methyl-cytidine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangnacancn

SEQ ID NO: 464 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (17)..(17): n is 2'-O-methyl-cytidine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcanancn

SEQ ID NO: 465 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (20)..(20): n is 2'-O-methyl-cytidine
  misc_feature (21)..(21): n is 5-[N-(1-naphthylmethyl)carboxyamide]-2'-deoxyuridine
cgacagcangnangcacannn

SEQ ID NO: 466 - DNA, 21 bp, Artificial Sequence
  Synthetic
  misc_feature (2)..(2): n is 2'-deoxyguanosine-3'-phosphorothioate
  misc_feature (2)..(2): n is 2'-O-methyl-guanosine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cnacagcangnangcacancn

SEQ ID NO: 467 - DNA, 21 bp, Artificial Sequence
  Synthetic
  misc_feature (6)..(6): n is 2'-O-methyl-guanosine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacancangnangcacancn

SEQ ID NO: 468 - DNA, 21 bp, Artificial Sequence
  Synthetic
  misc_feature (9)..(9): n is 5-[N-(1-naphthylmethyl)carboxyamide]-2'-deoxyuridine
  misc_feature (10)..(10): n is 2'-O-methyl-guanosine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcannnangcacancn

SEQ ID NO: 469 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (14)..(14): n is 2'-O-methyl-guanosine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnanncacancn

SEQ ID NO: 470 - DNA, 21 bp, Artificial Sequence
  Synthetic
  misc_feature (3)..(3): n is 2'-O-methyl-adenosine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgncagcangnangcacancn

SEQ ID NO: 471 - DNA, 21 bp, Artificial Sequence
  Synthetic
  misc_feature (5)..(5): n is 2'-O-methyl-adenosine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacngcangnangcacancn

SEQ ID NO: 472 - DNA, 21 bp, Artificial Sequence
  Synthetic
  misc_feature (8)..(8): n is 2'-O-methyl-adenosine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcnngnangcacancn

SEQ ID NO: 473 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (12)..(12): n is 2'-O-methyl-adenosine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnnngcacancn

SEQ ID NO: 474 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (16)..(16): n is 2'-O-methyl-adenosine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcncancn

SEQ ID NO: 475 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (18)..(18): n is 2'-O-methyl-adenosine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcacnncn

SEQ ID NO: 476 - DNA, 21 bp, Artificial Sequence
  Synthetic
  misc_feature (9)..(9): n is 5-[N-(1-naphthylmethyl)carboxyamide]-2'- O-methyl-uridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcacancn

SEQ ID NO: 477 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'- O-methyl-uridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcacancn

SEQ ID NO: 478 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'- O-methyl-uridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcacancn

SEQ ID NO: 479 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'- O-methyl-uridine
  misc_feature (21)..(21): n is 5-[N-(1-naphthylmethyl)carboxyamide]-2'-deoxyuridine
cgacagcangnangcacancn

SEQ ID NO: 480 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'- O-methyl-uridine
cgacagcangnangcacancn

SEQ ID NO: 481 - DNA, 21 bp, Artificial Sequence
  Synthetic
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcatgnangcacancn

SEQ ID NO: 482 - DNA, 21 bp, Artificial Sequence
  Synthetic
  misc_feature (9)..(9): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangtangcacancn

SEQ ID NO: 483 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnatgcacancn

SEQ ID NO: 484 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcacatcn

SEQ ID NO: 485 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
cgacagcangnangcacanct

SEQ ID NO: 486 - DNA, 21 bp, Artificial Sequence
  Synthetic
  misc_feature (7)..(7): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (16)..(16): n is 2'-O-methyl-adenosine
  misc_feature (18)..(18): n is 2'-O-methyl-adenosine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagnangnangcncnncn

SEQ ID NO: 487 - DNA, 21 bp, Artificial Sequence
  Synthetic
  misc_feature (7)..(7): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (14)..(14): n is 2'-O-methyl-guanosine
  misc_feature (16)..(16): n is 2'-O-methyl-adenosine
  misc_feature (18)..(18): n is 2'-O-methyl-adenosine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagnangnanncncnncn

SEQ ID NO: 488 - DNA, 21 bp, Artificial Sequence
  Synthetic
  misc_feature (6)..(6): n is 2'-O-methyl-guanosine
  misc_feature (7)..(7): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (14)..(14): n is 2'-O-methyl-guanosine
  misc_feature (16)..(16): n is 2'-O-methyl-adenosine
  misc_feature (18)..(18): n is 2'-O-methyl-adenosine
  misc_feature (19)..(19): n is 5-[N-(1-naphthylmethyl)carboxyamide]-2'-deoxyuridine
  misc_feature (20)..(20): n is 2'-O-methyl-cytidine
  misc_feature (21)..(21): n is 5-[N-(1-naphthylmethyl)carboxyamide]-2'- O-methyl-uridine
cgacannangnanncncnnnn

SEQ ID NO: 489 - DNA, 21 bp, Artificial Sequence
  Synthetic
  misc_feature (1)..(1): n is 2'-O-methyl-cytidine
  misc_feature (6)..(6): n is 2'-O-methyl-guanosine
  misc_feature (7)..(7): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (14)..(14): n is 2'-O-methyl-guanosine
  misc_feature (15)..(15): n is 2'-O-methyl-cytidine
  misc_feature (16)..(16): n is 2'-O-methyl-adenosine
  misc_feature (18)..(18): n is 2'-O-methyl-adenosine
  misc_feature (19)..(19): n is 5-[N-(1-naphthylmethyl)carboxyamide]-2'-deoxyuridine
  misc_feature (20)..(20): n is 2'-O-methyl-cytidine
  misc_feature (21)..(21): n is 5-[N-(1-naphthylmethyl)carboxyamide]-2'- O-methyl-uridine
ngacannangnannnncnnnn

SEQ ID NO: 490 - DNA, 21 bp, Artificial Sequence
  Synthetic
  misc_feature (1)..(1): n is 2'-O-methyl-cytidine
  misc_feature (4)..(4): n is 2'-O-methyl-cytidine
  misc_feature (6)..(6): n is 2'-O-methyl-guanosine
  misc_feature (7)..(7): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (14)..(14): n is 2'-O-methyl-guanosine
  misc_feature (15)..(15): n is 2'-O-methyl-cytidine
  misc_feature (16)..(16): n is 2'-O-methyl-adenosine
  misc_feature (18)..(18): n is 2'-O-methyl-adenosine
  misc_feature (19)..(19): n is 5-[N-(1-naphthylmethyl)carboxyamide]-2'-deoxyuridine
  misc_feature (20)..(20): n is 2'-O-methyl-cytidine
  misc_feature (21)..(21): n is 5-[N-(1-naphthylmethyl)carboxyamide]-2'- O-methyl-uridine
nganannangnannnncnnnn

SEQ ID NO: 491 - DNA, 21 bp, Artificial Sequence
  Synthetic
  misc_feature (1)..(1): n is 2'-O-methyl-cytidine
  misc_feature (4)..(4): n is 2'-O-methyl-cytidine
  misc_feature (6)..(6): n is 2'-O-methyl-guanosine
  misc_feature (7)..(7): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'- O-methyl-uridine
  misc_feature (13)..(13): n is 5-[N-(1-naphthylmethyl)carboxyamide]-2'-deoxyuridine
  misc_feature (14)..(14): n is 2'-O-methyl-guanosine
  misc_feature (15)..(15): n is 2'-O-methyl-cytidine
  misc_feature (16)..(16): n is 2'-O-methyl-adenosine
  misc_feature (17)..(17): n is 2'-O-methyl-cytidine
  misc_feature (18)..(18): n is 2'-O-methyl-adenosine
  misc_feature (19)..(19): n is 5-[N-(1-naphthylmethyl)carboxyamide]-2'-deoxyuridine
  misc_feature (20)..(20): n is 2'-O-methyl-cytidine
  misc_feature (21)..(21): n is 5-[N-(1-naphthylmethyl)carboxyamide]-2'- O-methyl-uridine
nganannangnannnnnnnnn

SEQ ID NO: 492 - DNA, 21 bp, Artificial Sequence
  Synthetic
  misc_feature (1)..(1): n is 2'-O-methyl-cytidine
  misc_feature (2)..(2): n is 2'-O-methyl-guanosine
  misc_feature (4)..(4): n is 2'-O-methyl-cytidine
  misc_feature (6)..(6): n is 2'-O-methyl-guanosine
  misc_feature (7)..(7): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'- O-methyl-uridine
  misc_feature (13)..(13): n is 5-[N-(1-naphthylmethyl)carboxyamide]-2'-deoxyuridine
  misc_feature (14)..(14): n is 2'-O-methyl-guanosine
  misc_feature (15)..(15): n is 2'-O-methyl-cytidine
  misc_feature (16)..(16): n is 2'-O-methyl-adenosine
  misc_feature (17)..(17): n is 2'-O-methyl-cytidine
  misc_feature (18)..(18): n is 2'-O-methyl-adenosine
  misc_feature (19)..(19): n is 5-[N-(1-naphthylmethyl)carboxyamide]-2'-deoxyuridine
  misc_feature (20)..(20): n is 2'-O-methyl-cytidine
  misc_feature (21)..(21): n is 5-[N-(1-naphthylmethyl)carboxyamide]-2'- O-methyl-uridine
nnanannangnannnnnnnnn

SEQ ID NO: 493 - DNA, 21 bp, Artificial Sequence
  Synthetic
  misc_feature (1)..(1): n is 2'-O-methyl-cytidine
  misc_feature (2)..(2): n is 2'-O-methyl-guanosine
  misc_feature (4)..(4): n is 2'-O-methyl-cytidine
  misc_feature (6)..(6): n is 2'-O-methyl-guanosine
  misc_feature (7)..(7): n is 2'-O-methyl-cytidine
  misc_feature (9)..(9): n is 5-[N-(1-naphthylmethyl)carboxyamide]-2'-deoxyuridine
  misc_feature (10)..(10): n is 2'-O-methyl-guanosine
  misc_feature (11)..(11): n is 5-[N-(1-naphthylmethyl)carboxyamide]-2'- O-methyl-uridine
  misc_feature (12)..(12): n is 2'-O-methyl-adenosine
  misc_feature (13)..(13): n is 5-[N-(1-naphthylmethyl)carboxyamide]-2'-deoxyuridine
  misc_feature (14)..(14): n is 2'-O-methyl-guanosine
  misc_feature (15)..(15): n is 2'-O-methyl-cytidine
  misc_feature (16)..(16): n is 2'-O-methyl-adenosine
  misc_feature (17)..(17): n is 2'-O-methyl-cytidine
  misc_feature (18)..(18): n is 2'-O-methyl-adenosine
  misc_feature (19)..(19): n is 5-[N-(1-naphthylmethyl)carboxyamide]-2'-deoxyuridine
  misc_feature (20)..(20): n is 2'-O-methyl-cytidine
  misc_feature (21)..(21): n is 5-[N-(1-naphthylmethyl)carboxyamide]-2'- O-methyl-uridine
nnanannannnnnnnnnnnnn

SEQ ID NO: 494 - DNA, 21 bp, Artificial Sequence
  Synthetic
  misc_feature (1)..(1): n is 2'-O-methyl-cytidine
  misc_feature (2)..(2): n is 2'-O-methyl-guanosine
  misc_feature (3)..(3): n is 2'-O-methyl-adenosine
  misc_feature (4)..(4): n is 2'-O-methyl-cytidine
  misc_feature (6)..(6): n is 2'-O-methyl-guanosine
  misc_feature (7)..(7): n is 2'-O-methyl-cytidine
  misc_feature (9)..(9): n is 5-[N-(1-naphthylmethyl)carboxyamide]-2'-deoxyuridine
  misc_feature (10)..(10): n is 2'-O-methyl-guanosine
  misc_feature (11)..(11): n is 5-[N-(1-naphthylmethyl)carboxyamide]-2'- O-methyl-uridine
  misc_feature (12)..(12): n is 2'-O-methyl-adenosine
  misc_feature (13)..(13): n is 5-[N-(1-naphthylmethyl)carboxyamide]-2'-deoxyuridine
  misc_feature (14)..(14): n is 2'-O-methyl-guanosine
  misc_feature (15)..(15): n is 2'-O-methyl-cytidine
  misc_feature (16)..(16): n is 2'-O-methyl-adenosine
  misc_feature (17)..(17): n is 2'-O-methyl-cytidine
  misc_feature (18)..(18): n is 2'-O-methyl-adenosine
  misc_feature (19)..(19): n is 5-[N-(1-naphthylmethyl)carboxyamide]-2'-deoxyuridine
  misc_feature (20)..(20): n is 2'-O-methyl-cytidine
  misc_feature (21)..(21): n is 5-[N-(1-naphthylmethyl)carboxyamide]-2'- O-methyl-uridine
nnnnannannnnnnnnnnnnn

SEQ ID NO: 495 - DNA, 21 bp, Artificial Sequence
  Synthetic
  misc_feature (1)..(1): n is 2'-O-methyl-cytidine
  misc_feature (2)..(2): n is 2'-O-methyl-guanosine
  misc_feature (3)..(3): n is 2'-O-methyl-adenosine
  misc_feature (4)..(4): n is 2'-O-methyl-cytidine
  misc_feature (6)..(6): n is 2'-O-methyl-guanosine
  misc_feature (7)..(7): n is 2'-O-methyl-cytidine
  misc_feature (9)..(9): n is 5-[N-(1-naphthylmethyl)carboxyamide]-2'-deoxyuridine
  misc_feature (10)..(10): n is 2'-O-methyl-guanosine
  misc_feature (11)..(11): n is 5-[N-(1-naphthylmethyl)carboxyamide]-2'- O-methyl-uridine
  misc_feature (12)..(12): n is 2'-O-methyl-adenosine
  misc_feature (13)..(13): n is 5-[N-(1-naphthylmethyl)carboxyamide]-2'- O-methyl-uridine
  misc_feature (14)..(14): n is 2'-O-methyl-guanosine
  misc_feature (15)..(15): n is 2'-O-methyl-cytidine
  misc_feature (16)..(16): n is 2'-O-methyl-adenosine
  misc_feature (17)..(17): n is 2'-O-methyl-cytidine
  misc_feature (18)..(18): n is 2'-O-methyl-adenosine
  misc_feature (19)..(19): n is 5-[N-(1-naphthylmethyl)carboxyamide]-2'- O-methyl-uridine
  misc_feature (20)..(20): n is 2'-O-methyl-cytidine
  misc_feature (21)..(21): n is 5-[N-(1-naphthylmethyl)carboxyamide]-2'- O-methyl-uridine
nnnnannannnnnnnnnnnnn

SEQ ID NO: 496 - DNA, 21 bp, Artificial Sequence
  Synthetic
  misc_feature (1)..(1): n is 2'-O-methyl-cytidine
  misc_feature (2)..(2): n is 2'-O-methyl-guanosine
  misc_feature (3)..(3): n is 2'-O-methyl-adenosine
  misc_feature (4)..(4): n is 2'-O-methyl-cytidine
  misc_feature (5)..(5): n is 2'-O-methyl-adenosine
  misc_feature (6)..(6): n is 2'-O-methyl-guanosine
  misc_feature (7)..(7): n is 2'-O-methyl-cytidine
  misc_feature (9)..(9): n is 5-[N-(1-naphthylmethyl)carboxyamide]-2'- O-methyl-uridine
  misc_feature (10)..(10): n is 2'-O-methyl-guanosine
  misc_feature (11)..(11): n is 5-[N-(1-naphthylmethyl)carboxyamide]-2'- O-methyl-uridine
  misc_feature (12)..(12): n is 2'-O-methyl-adenosine
  misc_feature (13)..(13): n is 5-[N-(1-naphthylmethyl)carboxyamide]-2'- O-methyl-uridine
  misc_feature (14)..(14): n is 2'-O-methyl-guanosine
  misc_feature (15)..(15): n is 2'-O-methyl-cytidine
  misc_feature (16)..(16): n is 2'-O-methyl-adenosine
  misc_feature (17)..(17): n is 2'-O-methyl-cytidine
  misc_feature (18)..(18): n is 2'-O-methyl-adenosine
  misc_feature (19)..(19): n is 5-[N-(1-naphthylmethyl)carboxyamide]-2'- O-methyl-uridine
  misc_feature (20)..(20): n is 2'-O-methyl-cytidine
  misc_feature (21)..(21): n is 5-[N-(1-naphthylmethyl)carboxyamide]-2'- O-methyl-uridine
nnnnnnnannnnnnnnnnnnn

SEQ ID NO: 497 - DNA, 21 bp, Artificial Sequence
  Synthetic
  misc_feature (1)..(1): n is 2'-O-methyl-cytidine
  misc_feature (2)..(2): n is 2'-O-methyl-guanosine
  misc_feature (3)..(3): n is 2'-O-methyl-adenosine
  misc_feature (4)..(4): n is 2'-O-methyl-cytidine
  misc_feature (5)..(5): n is 2'-O-methyl-adenosine
  misc_feature (6)..(6): n is 2'-O-methyl-guanosine
  misc_feature (7)..(7): n is 2'-O-methyl-cytidine
  misc_feature (8)..(8): n is 2'-O-methyl-adenosine
  misc_feature (9)..(9): n is 5-[N-(1-naphthylmethyl)carboxyamide]-2'- O-methyl-uridine
  misc_feature (10)..(10): n is 2'-O-methyl-guanosine
  misc_feature (11)..(11): n is 5-[N-(1-naphthylmethyl)carboxyamide]-2'- O-methyl-uridine
  misc_feature (12)..(12): n is 2'-O-methyl-adenosine
  misc_feature (13)..(13): n is 5-[N-(1-naphthylmethyl)carboxyamide]-2'- O-methyl-uridine
  misc_feature (14)..(14): n is 2'-O-methyl-guanosine
  misc_feature (15)..(15): n is 2'-O-methyl-cytidine
  misc_feature (16)..(16): n is 2'-O-methyl-adenosine
  misc_feature (17)..(17): n is 2'-O-methyl-cytidine
  misc_feature (18)..(18): n is 2'-O-methyl-adenosine
  misc_feature (19)..(19): n is 5-[N-(1-naphthylmethyl)carboxyamide]-2'- O-methyl-uridine
  misc_feature (20)..(20): n is 2'-O-methyl-cytidine
  misc_feature (21)..(21): n is 5-[N-(1-naphthylmethyl)carboxyamide]-2'- O-methyl-uridine
nnnnnnnnnnnnnnnnnnnnn

SEQ ID NO: 498 - DNA, 21 bp, Artificial Sequence
  Synthetic
  misc_feature (1)..(1): n is 2'-O-methyl-cytidine
  misc_feature (7)..(7): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (15)..(15): n is 2'-O-methyl-cytidine
  misc_feature (16)..(16): n is 2'-O-methyl-adenosine
  misc_feature (18)..(18): n is 2'-O-methyl-adenosine
  misc_feature (19)..(19): n is 5-[N-(1-naphthylmethyl)carboxyamide]-2'-deoxyuridine
  misc_feature (20)..(20): n is 2'-O-methyl-cytidine
  misc_feature (21)..(21): n is 5-[N-(1-naphthylmethyl)carboxyamide]-2'- O-methyl-uridine
ngacagnangnangnncnnnn

SEQ ID NO: 499 - DNA, 21 bp, Artificial Sequence
  Synthetic
  misc_feature (6)..(6): n is 2'-O-methyl-guanosine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (18)..(18): n is 2'-O-methyl-adenosine
  misc_feature (19)..(19): n is 5-[N-(1-naphthylmethyl)carboxyamide]-2'-deoxyuridine
  misc_feature (20)..(20): n is 2'-O-methyl-cytidine
  misc_feature (21)..(21): n is 5-[N-(1-naphthylmethyl)carboxyamide]-2'-deoxyuridine
cgacancangnangcacnnnn

SEQ ID NO: 500 - DNA, 24 bp, Artificial Sequence
  Synthetic
  misc_feature (1)..(1): n is a naturally occurring or modified nucleotide
  misc_feature (2)..(2): n is a modified pyrimidine
  misc_feature (5)..(5): n is Ln, wherein L is a spacer selected from a naturally occurring or modified nucleotide, a hydrocarbon linker, a polyethylene glycol linker or a combination thereof; n is 0 to 20
  misc_feature (6)..(6): n is C or G, and is complementary to the nucleotide at position 4
  misc_feature (7)..(7): n is C, G or a modified pyrimidine, and is complementary to the nucleotide at position 3
  misc_feature (8)..(8): n is a modified pyrimidine
  misc_feature (11)..(11): n is a naturally occurring or modified nucleotide
  misc_feature (12)..(12): n is Nm, wherein N is a naturally occurring or modified nucleotide; m is 0 to 20
  misc_feature (16)..(18): n is a modified pyrimidine
  misc_feature (20)..(20): n is a modified pyrimidine
nnvsnnnnacnngcgnnnanagcg

SEQ ID NO: 501 - DNA, 24 bp, Artificial Sequence
  Synthetic
  misc_feature (1)..(2): n is a modified pyrimidine
  misc_feature (5)..(5): n is Ln, wherein L is a spacer selected from a naturally occurring or modified nucleotide, a hydrocarbon linker, a polyethylene glycol linker or a combination thereof; n is 0 to 20
  misc_feature (6)..(6): n is C or G, and is complementary to the nucleotide at position 4
  misc_feature (7)..(7): n is C, G or a modified pyrimidine, and is complementary to the nucleotide at position 3
  misc_feature (8)..(8): n is a modified pyrimidine
  misc_feature (11)..(11): n is a naturally occurring or modified nucleotide
  misc_feature (12)..(12): n is Nm, wherein N is a naturally occurring or modified nucleotide; m is 0 to 20
  misc_feature (16)..(18): n is a modified pyrimidine
  misc_feature (20)..(20): n is a modified pyrimidine
nnvsnnnnacnngcgnnnanagcg

SEQ ID NO: 502 - DNA, 24 bp, Artificial Sequence
  Synthetic
  misc_feature (1)..(2): n is a modified pyrimidine
  misc_feature (5)..(5): n is Ln, wherein L is a spacer selected from a substituted or unsubstituted C2-C20 linker and a modified or unmodified nucleotide, a naturally occurring or modified nucleotide, a hydrocarbon linker, a polyethylene glycol linker or a combination
  misc_feature (7)..(7): n is C, G or a modified pyrimidine, and is complementary to the nucleotide at position 3
  misc_feature (8)..(8): n is a modified pyrimidine
  misc_feature (11)..(11): n is a naturally occurring or modified nucleotide
  misc_feature (16)..(18): n is a modified pyrimidine
  misc_feature (20)..(20): n is a modified pyrimidine
nnvcngnnacnmgcgnnnanagcg

SEQ ID NO: 503 - DNA, 24 bp, Artificial Sequence
  Synthetic
  misc_feature (1)..(2): n is a modified pyrimidine
  misc_feature (5)..(5): n is Ln, wherein L is a spacer selected from a naturally occurring or modified nucleotide, a hydrocarbon linker, a polyethylene glycol linker or a combination thereof; n is 0 to 20
  misc_feature (7)..(8): n is a modified pyrimidine
  misc_feature (16)..(18): n is a modified pyrimidine
  misc_feature (20)..(20): n is a modified pyrimidine
nnacngnnacacgcgnnnanagcg

SEQ ID NO: 504 - DNA, 29 bp, Artificial Sequence
  Synthetic
  misc_feature (1)..(2): n is a modified pyrimidine
  misc_feature (8)..(8): n is a modified pyrimidine
  misc_feature (12)..(13): n is a modified pyrimidine
  misc_feature (21)..(23): n is a modified pyrimidine
  misc_feature (25)..(25): n is a modified pyrimidine
nnacgacnacgnnacacgcgnnnanagcg

SEQ ID NO: 505 - DNA, 20 bp, Artificial Sequence
  Synthetic
  misc_feature (1)..(1): n is a modified pyrimidine
  misc_feature (3)..(3): n is C, or a substituted or unsubstituted C2-C10 linker
  misc_feature (4)..(4): n is Lp, wherein L is independently selected from a substituted or unsubstituted C2-C10 linker, a polyethylene glycol linker, and a modified or unmodified nucleotide; p is 1 to 10
  misc_feature (6)..(6): n is a modified or unmodified pyrimidine
  misc_feature (7)..(7): n is a modified pyrimidine
  misc_feature (9)..(9): n is C, or a substituted or unsubstituted C2-C10 linker
  misc_feature (10)..(10): n is Kq, wherein K is independently selected from a substituted or unsubstituted C2-C10 linker, a polyethylene glycol linker, and a modified or unmodified nucleotide; q is 1 to 5
  misc_feature (14)..(15): n is a modified pyrimidine
  misc_feature (16)..(16): n is a modified or unmodified pyrimidine
  misc_feature (17)..(17): n is A, or a substituted or unsubstituted C2-C10 linker
  misc_feature (18)..(18): n is a modified or unmodified pyrimidine
nanngnnanngcgnnnnnag

SEQ ID NO: 506 - DNA, 23 bp, Artificial Sequence
  Synthetic
  misc_feature (1)..(1): n is a modified or unmodified pyrimidine, a substituted or unsubstituted C2-C10 linker, or is absent
  misc_feature (2)..(2): n is a modified pyrimidine
  misc_feature (4)..(4): n is C, or a substituted or unsubstituted C2-C10 linker
  misc_feature (5)..(5): n is Lp, wherein L is independently selected from a substituted or unsubstituted C2-C10 linker, a polyethylene glycol linker, and a modified or unmodified nucleotide; p is 1 to 10
  misc_feature (7)..(7): n is a modified or unmodified pyrimidine
  misc_feature (8)..(8): n is a modified pyrimidine
  misc_feature (10)..(10): n is C, or a substituted or unsubstituted C2-C10 linker
  misc_feature (11)..(11): n is Kq, wherein K is independently selected from a substituted or unsubstituted C2-C10 linker, a polyethylene glycol linker, and a modified or unmodified nucleotide; q is 1 to 5
  misc_feature (15)..(16): n is a modified pyrimidine
  misc_feature (17)..(17): n is a modified or unmodified pyrimidine
  misc_feature (18)..(18): n is A, or a substituted or unsubstituted C2-C10 linker
  misc_feature (19)..(19): n is a modified or unmodified pyrimidine
  misc_feature (22)..(22): n is C, or a substituted or unsubstituted C2-C10 linker
  misc_feature (23)..(23): n is G, a substituted or unsubstituted C2-C10 linker, or is absent
nnanngnnanngcgnnnnnagnn

SEQ ID NO: 507 - DNA, 21 bp, Artificial Sequence
  Synthetic
  misc_feature (1)..(1): n is a modified pyrimidine
  misc_feature (4)..(4): n is Ln, wherein L is selected from a substituted or unsubstituted C2-C20 linker and a modified or unmodified nucleotide; n is 1 to 50
  misc_feature (5)..(5): n is a C or G, is complementary to the nucleotide at position 3
  misc_feature (6)..(6): n is a C, G or a modified pyrimidine, and is complementary to the nucleotide at position 2
  misc_feature (7)..(7): n is a modified pyrimidine
  misc_feature (10)..(10): n is a modified or unmodified nucleotide
  misc_feature (11)..(11): n is Nm, N is a modified or unmodified nucleotide; m is 0 to 50
  misc_feature (15)..(17): n is a modified pyrimidine
  misc_feature (19)..(19): n is a modified pyrimidine
nvsnnnnacnngcgnnnanag

SEQ ID NO: 508 - DNA, 23 bp, Artificial Sequence
  Synthetic
  misc_feature (1)..(1): n is a modified pyrimidine or dT
  misc_feature (2)..(2): n is a modified pyrimidine
  misc_feature (5)..(5): n is Ln, wherein L is selected from a substituted or unsubstituted C2-C20 linker and a modified or unmodified nucleotide; n is 1 to 50
  misc_feature (6)..(6): n is a C or G, is complementary to the nucleotide at position 4
  misc_feature (7)..(7): n is a C, G or Z, and is complementary to the nucleotide at position 3
  misc_feature (8)..(8): n is a modified pyrimidine
  misc_feature (11)..(11): n is a modified or unmodified nucleotide
  misc_feature (12)..(12): n is Nm, N is a modified or unmodified nucleotide; m is 0 to 50
  misc_feature (16)..(18): n is a modified pyrimidine
  misc_feature (20)..(20): n is a modified pyrimidine
nnvsnnnnacnngcgnnnanagc

SEQ ID NO: 509 - DNA, 23 bp, Artificial Sequence
  Synthetic
  misc_feature (1)..(1): n is a modified pyrimidine or dT
  misc_feature (2)..(2): n is a modified pyrimidine
  misc_feature (5)..(5): n is Ln, wherein L is selected from a substituted or unsubstituted C2-C20 linker and a modified or unmodified nucleotide; n is 1 to 50
  misc_feature (7)..(7): n is C, G or Z, and is complementary to the nucleotide at position 3
  misc_feature (8)..(8): n is a modified pyrimidine
  misc_feature (11)..(11): n is a modified or unmodified nucleotide
  misc_feature (16)..(18): n is a modified pyrimidine
  misc_feature (20)..(20): n is a modified pyrimidine
nnvcngnnacnmgcgnnnanagc

SEQ ID NO: 510 - DNA, 23 bp, Artificial Sequence
  Synthetic
  misc_feature (1)..(1): n is a modified pyrimidine or dT
  misc_feature (2)..(2): n is a modified pyrimidine
  misc_feature (5)..(5): n is Ln, wherein L is selected from a substituted or unsubstituted C2-C20 linker and a modified or unmodified nucleotide; n is 1 to 50
  misc_feature (7)..(8): n is a modified pyrimidine
  misc_feature (16)..(18): n is a modified pyrimidine
  misc_feature (20)..(20): n is a modified pyrimidine
nnacngnnacacgcgnnnanagc

SEQ ID NO: 511 - DNA, 28 bp, Artificial Sequence
  Synthetic
  misc_feature (1)..(1): n is a modified pyrimidine or dT
  misc_feature (2)..(2): n is a modified pyrimidine
  misc_feature (8)..(8): n is a modified pyrimidine
  misc_feature (12)..(13): n is a modified pyrimidine
  misc_feature (21)..(23): n is a modified pyrimidine
  misc_feature (25)..(25): n is a modified pyrimidine
nnacgacnacgnnacacgcgnnnanagc

SEQ ID NO: 512 - DNA, 14 bp, Artificial Sequence
  Synthetic
  misc_feature (4)..(4): n is Ln, wherein L is a substituted or unsubstituted C2-C50 linker, a polyethylene glycol linker, or a modified or unmodified nucleotide; n is 1 to 5
  misc_feature (5)..(5): n is a modified pyrimidine
  misc_feature (7)..(7): n is a modified pyrimidine
  misc_feature (9)..(9): n is a modified pyrimidine
  misc_feature (11)..(11): n is Lm, wherein L is a substituted or unsubstituted C2-C50 linker, a polyethylene glycol linker, or a modified or unmodified nucleotide; m is 1 to 10
  misc_feature (12)..(12): n is a modified pyrimidine
  misc_feature (13)..(13): n is a substituted or unsubstituted C2-C50 linker, a polyethylene glycol linker, or a modified or unmodified nucleotide
  misc_feature (14)..(14): n is a modified pyrimidine
acanngnangnnnn

SEQ ID NO: 513 - DNA, 27 bp, Artificial Sequence
  Synthetic
  misc_feature (2)..(3): n is a modified pyrimidine
  misc_feature (4)..(4): n is a modified or unmodified nucleotide, a substituted or unsubstituted C2-C50 linker, or is absent
  misc_feature (7)..(7): n is G, or a substituted or unsubstituted C2-C50 linker
  misc_feature (8)..(8): n is a modified pyrimidine
  misc_feature (9)..(9): n is G, or a substituted or unsubstituted C2-C50 linker
  misc_feature (11)..(12): n is a modified pyrimidine
  misc_feature (13)..(13): n is G, or a substituted or unsubstituted C2-C50 linker
  misc_feature (14)..(14): n is a modified pyrimidine
  misc_feature (15)..(15): n is A, or a substituted or unsubstituted C2-C50 linker
  misc_feature (16)..(16): n is a modified or unmodified nucleotide, a substituted or unsubstituted C2-C50 linker
  misc_feature (19)..(21): n is a modified pyrimidine
  misc_feature (25)..(25): n is a modified pyrimidine
gnnnaannncnnnnnngannnaaangg

SEQ ID NO: 514 - DNA, 27 bp, Artificial Sequence
  Synthetic
  misc_feature (3)..(4): n is a modified pyrimidine
  misc_feature (5)..(5): n is a modified or unmodified nucleotide, a substituted or unsubstituted C2-C50 linker, or is absent
  misc_feature (8)..(8): n is G, or a substituted or unsubstituted C2-C50 linker
  misc_feature (9)..(9): n is a modified pyrimidine
  misc_feature (10)..(10): n is G, or a substituted or unsubstituted C2-C50 linker
  misc_feature (12)..(13): n is a modified pyrimidine
  misc_feature (14)..(14): n is G, or a substituted or unsubstituted C2-C50 linker
  misc_feature (15)..(15): n is a modified pyrimidine
  misc_feature (16)..(16): n is A, or a substituted or unsubstituted C2-C50 linker
  misc_feature (17)..(17): n is a modified or unmodified nucleotide, a substituted or unsubstituted C2-C50 linker
  misc_feature (20)..(22): n is a modified pyrimidine
  misc_feature (26)..(26): n is a modified pyrimidine
cgnnnaannncnnnnnngannnaaang

SEQ ID NO: 515 - DNA, 28 bp, Artificial Sequence
  Synthetic
  misc_feature (3)..(4): n is a modified pyrimidine
  misc_feature (5)..(5): n is a modified or unmodified nucleotide, a substituted or unsubstituted C2-C50 linker, or is absent
  misc_feature (8)..(8): n is G, or a substituted or unsubstituted C2-C50 linker
  misc_feature (9)..(9): n is a modified pyrimidine
  misc_feature (10)..(10): n is G, or a substituted or unsubstituted C2-C50 linker
  misc_feature (12)..(13): n is a modified pyrimidine
  misc_feature (14)..(14): n is G, or a substituted or unsubstituted C2-C50 linker
  misc_feature (15)..(15): n is a modified pyrimidine
  misc_feature (16)..(16): n is A, or a substituted or unsubstituted C2-C50 linker
  misc_feature (17)..(17): n is a modified or unmodified nucleotide, a substituted or unsubstituted C2-C50 linker
  misc_feature (20)..(22): n is a modified pyrimidine
  misc_feature (26)..(26): n is a modified pyrimidine
cgnnnaannncnnnnnngannnaaangg

SEQ ID NO: 516 - DNA, 29 bp, Artificial Sequence
  Synthetic
  misc_feature (4)..(5): n is a modified pyrimidine
  misc_feature (6)..(6): n is a modified or unmodified nucleotide, a substituted or unsubstituted C2-C50 linker, or is absent
  misc_feature (9)..(9): n is G, or a substituted or unsubstituted C2-C50 linker
  misc_feature (10)..(10): n is a modified pyrimidine
  misc_feature (11)..(11): n is G, or a substituted or unsubstituted C2-C50 linker
  misc_feature (13)..(14): n is a modified pyrimidine
  misc_feature (15)..(15): n is G, or a substituted or unsubstituted C2-C50 linker
  misc_feature (16)..(16): n is a modified pyrimidine
  misc_feature (17)..(17): n is A, or a substituted or unsubstituted C2-C50 linker
  misc_feature (18)..(18): n is a modified or unmodified nucleotide, a substituted or unsubstituted C2-C50 linker
  misc_feature (21)..(23): n is a modified pyrimidine
  misc_feature (27)..(27): n is a modified pyrimidine
ccgnnnaannncnnnnnngannnaaangg

SEQ ID NO: 517 - DNA, 21 bp, Artificial Sequence
  Synthetic
  misc_feature (1)..(1): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (18)..(18): n is 2'-O-methyl-adenosine
  misc_feature (19)..(19): n is 5-[N-(1-naphthylmethyl)carboxyamide]-2'-deoxyuridine
  misc_feature (20)..(20): n is 2'-O-methyl-cytidine
  misc_feature (21)..(21): n is 5-[N-(1-naphthylmethyl)carboxyamide]-2'-deoxyuridine
ngacagcangnangcacnnnn

SEQ ID NO: 518 - DNA, 21 bp, Artificial Sequence
  Synthetic
  misc_feature (1)..(1): n is 2'-O-methyl-cytidine
  misc_feature (6)..(6): n is 2'-O-methyl-guanosine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (18)..(18): n is 2'-O-methyl-adenosine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
ngacancangnangcacnncn

SEQ ID NO: 519 - DNA, 21 bp, Artificial Sequence
  Synthetic
  misc_feature (1)..(1): n is 2'-O-methyl-cytidine
  misc_feature (6)..(6): n is 2'-O-methyl-guanosine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (14)..(14): n is 2'-O-methyl-guanosine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
ngacancangnanncacancn

SEQ ID NO: 520 - DNA, 21 bp, Artificial Sequence
  Synthetic
  misc_feature (1)..(1): n is 2'-O-methyl-cytidine
  misc_feature (6)..(6): n is 2'-O-methyl-guanosine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (16)..(16): n is 2'-O-methyl-adenosine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
ngacancangnangcncancn

SEQ ID NO: 521 - DNA, 21 bp, Artificial Sequence
  Synthetic
  misc_feature (1)..(1): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (14)..(14): n is 2'-O-methyl-guanosine
  misc_feature (16)..(16): n is 2'-O-methyl-adenosine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
ngacagcangnanncncancn

SEQ ID NO: 522 - DNA, 21 bp, Artificial Sequence
  Synthetic
  misc_feature (7)..(7): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (14)..(14): n is 2'-O-methyl-guanosine
  misc_feature (16)..(16): n is 2'-O-methyl-adenosine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagnangnanncncancn

SEQ ID NO: 523 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (14)..(14): n is 2'-O-methyl-guanosine
  misc_feature (16)..(16): n is 2'-O-methyl-adenosine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'- O-methyl-uridine
cgacagcangnanncncancn

SEQ ID NO: 524 - DNA, 21 bp, Artificial Sequence
  Synthetic
  misc_feature (7)..(7): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (16)..(16): n is 2'-O-methyl-adenosine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'- O-methyl-uridine
cgacagnangnangcncancn

SEQ ID NO: 525 - DNA, 21 bp, Artificial Sequence
  Synthetic
  misc_feature (7)..(7): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (17)..(17): n is 2'-O-methyl-cytidine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'- O-methyl-uridine
cgacagnangnangcanancn

SEQ ID NO: 526 - DNA, 21 bp, Artificial Sequence
  Synthetic
  misc_feature (4)..(4): n is 2'-O-methyl-cytidine
  misc_feature (7)..(7): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'- O-methyl-uridine
cganagnangnangcacancn

SEQ ID NO: 527 - DNA, 21 bp, Artificial Sequence
  Synthetic
  misc_feature (4)..(4): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (17)..(17): n is 2'-O-methyl-cytidine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cganagcangnangcanancn

SEQ ID NO: 528 - DNA, 21 bp, Artificial Sequence
  Synthetic
  misc_feature (4)..(4): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (12)..(12): n is 2'-O-methyl-adenosine
  misc_feature (13)..(13): n is 5-[N-(1-naphthylmethyl)carboxyamide]-2'-deoxyuridine
  misc_feature (17)..(17): n is 2'-O-methyl-cytidine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cganagcangnnngcanancn

SEQ ID NO: 529 - DNA, 21 bp, Artificial Sequence
  Synthetic
  misc_feature (2)..(2): n is 2'-O-methyl-guanosine
  misc_feature (4)..(4): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (17)..(17): n is 2'-O-methyl-cytidine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cnanagcangnangcanancn

SEQ ID NO: 530 - DNA, 21 bp, Artificial Sequence
  Synthetic
  misc_feature (2)..(2): n is 2'-O-methyl-guanosine
  misc_feature (4)..(4): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (17)..(17): n is 2'-O-methyl-cytidine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cnanagcangnangcanancn

SEQ ID NO: 531 - DNA, 21 bp, Artificial Sequence
  Synthetic
  misc_feature (2)..(2): n is 2'-O-methyl-guanosine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (12)..(12): n is 2'-O-methyl-adenosine
  misc_feature (13)..(13): n is 5-[N-(1-naphthylmethyl)carboxyamide]-2'-deoxyuridine
  misc_feature (15)..(15): 2'-O-methyl-cytidine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cnacagcangnnngnacancn

SEQ ID NO: 532 - DNA, 21 bp, Artificial Sequence
  Synthetic
  misc_feature (2)..(2): n is 2'-O-methyl-guanosine
  misc_feature (9)..(9): n is 5-[N-(1-naphthylmethyl)carboxyamide]-2'-deoxyuridine
  misc_feature (10)..(10): n is 2'-O-methyl-guanosine
  misc_feature (11)..(11): n is 5-[N-(1-naphthylmethyl)carboxyamide]-2'-deoxyuridine
  misc_feature (12)..(12): n is 2'-O-methyl-adenosine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cnacagcannnnngcacancn

SEQ ID NO: 533 - DNA, 21 bp, Artificial Sequence
  Synthetic
  misc_feature (2)..(2): n is 2'-O-methyl-guanosine
  misc_feature (9)..(9): n is 5-[N-(1-naphthylmethyl)carboxyamide]-2'-deoxyuridine
  misc_feature (10)..(10): n is 2'-O-methyl-guanosine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (15)..(15): n is 2'-O-methyl-cytidine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cnacagcannnangnacancn

SEQ ID NO: 534 - DNA, 21 bp, Artificial Sequence
  Synthetic
  misc_feature (1)..(1): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (20)..(20): n is 2'-O-methyl-cytidine
  misc_feature (21)..(21): n is 5-[N-(1-naphthylmethyl)carboxyamide]-2'- O-methyl-uridine
ngacagcangnangcacannn

SEQ ID NO: 535 - DNA, 21 bp, Artificial Sequence
  Synthetic
  misc_feature (5)..(5): n is 2'-O-methyl-adenosine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (20)..(20): n is 2'-O-methyl-cytidine
  misc_feature (21)..(21): n is 5-[N-(1-naphthylmethyl)carboxyamide]-2'- O-methyl-uridine
cgacngcangnangcacannn

SEQ ID NO: 536 - DNA, 21 bp, Artificial Sequence
  Synthetic
  misc_feature (1)..(1): n is 2'-O-methyl-cytidine
  misc_feature (5)..(5): n is 2'-O-methyl-adenosine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (20)..(20): n is 2'-O-methyl-cytidine
  misc_feature (21)..(21): n is 5-[N-(1-naphthylmethyl)carboxyamide]-2'-deoxyuridine
ngacngcangnangcacannn

SEQ ID NO: 537 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'- O-methyl-uridine
  misc_feature (20)..(20): n is 2'-O-methyl-cytidine
  misc_feature (21)..(21): n is 5-[N-(1-naphthylmethyl)carboxyamide]-2'- O-methyl-uridine
cgacagcangnangcacannn

SEQ ID NO: 538 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (16)..(16): n is 2'-O-methyl-adenosine
  misc_feature (17)..(17): n is 2'-O-methyl-cytidine
  misc_feature (18)..(18): n is 2'-O-methyl-adenosine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnangcnnnncn

SEQ ID NO: 539 - DNA, 21 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'- O-methyl-uridine
  misc_feature (14)..(14): n is 2'-O-methyl-guanosine
  misc_feature (15)..(15): n is 2'-O-methyl-cytidine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcangnannnacancn

SEQ ID NO: 540 - DNA, 21 bp, Artificial Sequence
  Synthetic
  misc_feature (9)..(9): n is 5-[N-(1-naphthylmethyl)carboxyamide]-2'-deoxyuridine
  misc_feature (10)..(10): n is 2'-O-methyl-guanosine
  misc_feature (11)..(11): n is 5-[N-(1-naphthylmethyl)carboxyamide]-2'-O-methyl-uridine
  misc_feature (12)..(12): n is 2'-O-methyl-adenosine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagcannnnngcacancn

SEQ ID NO: 541 - DNA, 21 bp, Artificial Sequence
  Synthetic
  misc_feature (7)..(7): n is 2'-O-methyl-cytidine
  misc_feature (8)..(8): n is 2'-O-methyl-adenosine
  misc_feature (9)..(9): n is 5-[N-(1-naphthylmethyl)carboxyamide]-2'-O-methyl-uridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgacagnnngnangcacancn

SEQ ID NO: 542 - DNA, 21 bp, Artificial Sequence
  Synthetic
  misc_feature (4)..(4): n is 2'-O-methyl-cytidine
  misc_feature (5)..(5): n is 2'-O-methyl-adenosine
  misc_feature (6)..(6): n is 2'-O-methyl-guanosine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
cgannncangnangcacancn

SEQ ID NO: 543 - DNA, 21 bp, Artificial Sequence
  Synthetic
  misc_feature (1)..(1): n is 2'-O-methyl-cytidine
  misc_feature (2)..(2): n is 2'-O-methyl-guanosine
  misc_feature (3)..(3): n is 2'-O-methyl-adenosine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
nnncagcangnangcacancn

SEQ ID NO: 544 - DNA, 21 bp, Artificial Sequence
  Synthetic
  misc_feature (1)..(1): n is 2'-O-methyl-cytidine
  misc_feature (7)..(7): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (14)..(14): n is 2'-O-methyl-guanosine
  misc_feature (16)..(16): n is 2'-O-methyl-adenosine
  misc_feature (18)..(18): n is 2'-O-methyl-adenosine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-O-methyl-uridine
ngacagnangnanncncnncn

SEQ ID NO: 545 - DNA, 21 bp, Artificial Sequence
  Synthetic
  misc_feature (1)..(1): n is 2'-O-methyl-cytidine
  misc_feature (4)..(4): n is 2'-O-methyl-cytidine
  misc_feature (6)..(6): n is 2'-O-methyl-guanosine
  misc_feature (7)..(7): n is 2'-O-methyl-cytidine
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (14)..(14): n is 2'-O-methyl-guanosine
  misc_feature (15)..(15): n is 2'-O-methyl-cytidine
  misc_feature (16)..(16): n is 2'-O-methyl-adenosine
  misc_feature (17)..(17): n is 2'-O-methyl-cytidine
  misc_feature (18)..(18): n is 2'-O-methyl-adenosine
  misc_feature (19)..(19): n is 5-[N-(1-naphthylmethyl)carboxyamide]-2'-deoxyuridine
  misc_feature (20)..(20): n is 2'-O-methyl-cytidine
  misc_feature (21)..(21): n is 5-[N-(1-naphthylmethyl)carboxyamide]-2'-O-methyl-uridine
nganannangnannnnnnnnn

SEQ ID NO: 546 - DNA, 38 bp, Artificial Sequence
  Synthetic
  misc_feature (5)..(5): n is 5-[N-(1-naphthylmethyl)carboxyamide]-2'-deoxyuridine
  misc_feature (12)..(13): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (21)..(22): n is 5-[N-(1-naphthylmethyl)carboxyamide]-2'-deoxyuridine
  misc_feature (24)..(24): n is 5-[N-(1-naphthylmethyl)carboxyamide]-2'-deoxyuridine
  misc_feature (29)..(31): n is 5-[N-(1-naphthylmethyl)carboxyamide]-2'-deoxyuridine
  misc_feature (35)..(35): n is 5-[N-(1-naphthylmethyl)carboxyamide]-2'-deoxyuridine
tcaancagccgnncaagngcnngnaggannnaaangga

SEQ ID NO: 547 - DNA, 37 bp, Artificial Sequence
  Synthetic
  misc_feature (5)..(5): n is 5-[N-(1-naphthylmethyl)carboxyamide]-2'-deoxyuridine
  misc_feature (12)..(13): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (21)..(22): n is 5-[N-(1-naphthylmethyl)carboxyamide]-2'-deoxyuridine
  misc_feature (24)..(24): n is 5-[N-(1-naphthylmethyl)carboxyamide]-2'-deoxyuridine
  misc_feature (29)..(31): n is 5-[N-(1-naphthylmethyl)carboxyamide]-2'-deoxyuridine
  misc_feature (35)..(35): n is 5-[N-(1-naphthylmethyl)carboxyamide]-2'-deoxyuridine
tcaancagccgnncaagngcnngnaggannnaaangg

SEQ ID NO: 548 - DNA, 36 bp, Artificial Sequence
  Synthetic
  misc_feature (5)..(5): n is 5-[N-(1-naphthylmethyl)carboxyamide]-2'-deoxyuridine
  misc_feature (12)..(13): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (21)..(22): n is 5-[N-(1-naphthylmethyl)carboxyamide]-2'-deoxyuridine
  misc_feature (24)..(24): n is 5-[N-(1-naphthylmethyl)carboxyamide]-2'-deoxyuridine
  misc_feature (29)..(31): n is 5-[N-(1-naphthylmethyl)carboxyamide]-2'-deoxyuridine
  misc_feature (35)..(35): n is 5-[N-(1-naphthylmethyl)carboxyamide]-2'-deoxyuridine
tcaancagccgnncaagngcnngnaggannnaaang

SEQ ID NO: 549 - DNA, 35 bp, Artificial Sequence
  Synthetic
  misc_feature (5)..(5): n is 5-[N-(1-naphthylmethyl)carboxyamide]-2'-deoxyuridine
  misc_feature (12)..(13): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (21)..(22): n is 5-[N-(1-naphthylmethyl)carboxyamide]-2'-deoxyuridine
  misc_feature (24)..(24): n is 5-[N-(1-naphthylmethyl)carboxyamide]-2'-deoxyuridine
  misc_feature (29)..(31): n is 5-[N-(1-naphthylmethyl)carboxyamide]-2'-deoxyuridine
  misc_feature (35)..(35): n is 5-[N-(1-naphthylmethyl)carboxyamide]-2'-deoxyuridine
tcaancagccgnncaagngcnngnaggannnaaan

SEQ ID NO: 550 - DNA, 39 bp, Artificial Sequence
  Synthetic
  misc_feature (4)..(4): n is 5-[N-(1-naphthylmethyl)carboxyamide]-2'-deoxyuridine
  misc_feature (11)..(12): n is 5-[N-(1-naphthylmethyl)carboxyamide]-2'-deoxyuridine
  misc_feature (17)..(17): n is 5-[N-(1-naphthylmethyl)carboxyamide]-2'-deoxyuridine
  misc_feature (20)..(21): n is 5-[N-(1-naphthylmethyl)carboxyamide]-2'-deoxyuridine
  misc_feature (23)..(23): n is 5-[N-(1-naphthylmethyl)carboxyamide]-2'-deoxyuridine
  misc_feature (28)..(30): n is 5-[N-(1-naphthylmethyl)carboxyamide]-2'-deoxyuridine
  misc_feature (34)..(34): n is 5-[N-(1-naphthylmethyl)carboxyamide]-2'-deoxyuridine
  misc_feature (39)..(39): n is 5-[N-(1-naphthylmethyl)carboxyamide]-2'-deoxyuridine
caancagccgnncaagngcnngnaggannnaaanggaan

SEQ ID NO: 551 - DNA, 38 bp, Artificial Sequence
  Synthetic
  misc_feature (3)..(3): n is 5-[N-(1-naphthylmethyl)carboxyamide]-2'-deoxyuridine
  misc_feature (10)..(11): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (19)..(20): n is 5-[N-(1-naphthylmethyl)carboxyamide]-2'-deoxyuridine
  misc_feature (22)..(22): n is 5-[N-(1-naphthylmethyl)carboxyamide]-2'-deoxyuridine
  misc_feature (27)..(29): n is 5-[N-(1-naphthylmethyl)carboxyamide]-2'-deoxyuridine
  misc_feature (33)..(33): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
aancagccgnncaagngcnngnaggannnaaanggaan

SEQ ID NO: 552 - DNA, 37 bp, Artificial Sequence
  Synthetic
  misc_feature (2)..(2): n is 5-[N-(1-naphthylmethyl)carboxyamide]-2'-deoxyuridine
  misc_feature (9)..(10): n is 5-[N-(1-naphthylmethyl)carboxyamide]-2'-deoxyuridine
  misc_feature (15)..(15): n is 5-[N-(1-naphthylmethyl)carboxyamide]-2'-deoxyuridine
  misc_feature (18)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (26)..(28): n is 5-[N-(1-naphthylmethyl)carboxyamide]-2'-deoxyuridine
  misc_feature (32)..(32): n is 5-[N-(1-naphthylmethyl)carboxyamide]-2'-deoxyuridine
  misc_feature (37)..(37): n is 5-[N-(1-naphthylmethyl)carboxyamide]-2'-deoxyuridine
ancagccgnncaagngcnngnaggannnaaanggaan

SEQ ID NO: 553 - DNA, 36 bp, Artificial Sequence
  Synthetic
  misc_feature (1)..(1): n is 5-[N-(1-naphthylmethyl)carboxyamide]-2'-deoxyuridine
  misc_feature (8)..(9): n is 5-[N-(1-naphthylmethyl)carboxyamide]-2'-deoxyuridine
  misc_feature (14)..(14): n is 5-[N-(1-naphthylmethyl)carboxyamide]-2'-deoxyuridine
  misc_feature (17)..(18): n is 5-[N-(1-naphthylmethyl)carboxyamide]-2'-deoxyuridine
  misc_feature (20)..(20): n is 5-[N-(1-naphthylmethyl)carboxyamide]-2'-deoxyuridine
  misc_feature (25)..(27): n is 5-[N-(1-naphthylmethyl)carboxyamide]-2'-deoxyuridine
  misc_feature (31)..(31): n is 5-[N-(1-naphthylmethyl)carboxyamide]-2'-deoxyuridine
  misc_feature (36)..(36): n is 5-[N-(1-naphthylmethyl)carboxyamide]-2'-deoxyuridine
ncagccgnncaagngcnngnaggannnaaanggaan

SEQ ID NO: 554 - DNA, 35 bp, Artificial Sequence
  Synthetic
  misc_feature (7)..(8): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (16)..(17): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (24)..(26): n is 5-[N-(1-naphthylmethyl)carboxyamide]-2'-deoxyuridine
  misc_feature (30)..(30): n is 5-[N-(1-naphthylmethyl)carboxyamide]-2'-deoxyuridine
  misc_feature (35)..(35): n is 5-[N-(1-naphthylmethyl)carboxyamide]-2'-deoxyuridine
cagccgnncaagngcnngnaggannnaaanggaan

SEQ ID NO: 555 - DNA, 34 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
  misc_feature (34)..(34): n is 5-[N-(1-naphthylmethyl)carboxyamide]-2'-deoxyuridine
agccgnncaagngcnngnaggannnaaanggaan

SEQ ID NO: 556 - DNA, 38 bp, Artificial Sequence
  Synthetic
  misc_feature (4)..(4): n is 5-[N-(1-naphthylmethyl)carboxyamide]-2'-deoxyuridine
  misc_feature (11)..(12): n is 5-[N-(1-naphthylmethyl)carboxyamide]-2'-deoxyuridine
  misc_feature (17)..(17): n is 5-[N-(1-naphthylmethyl)carboxyamide]-2'-deoxyuridine
  misc_feature (20)..(21): n is 5-[N-(1-naphthylmethyl)carboxyamide]-2'-deoxyuridine
  misc_feature (23)..(23): n is 5-[N-(1-naphthylmethyl)carboxyamide]-2'-deoxyuridine
  misc_feature (28)..(30): n is 5-[N-(1-naphthylmethyl)carboxyamide]-2'-deoxyuridine
  misc_feature (34)..(34): n is 5-[N-(1-naphthylmethyl)carboxyamide]-2'-deoxyuridine
caancagccgnncaagngcnngnaggannnaaanggaa

SEQ ID NO: 557 - DNA, 37 bp, Artificial Sequence
  Synthetic
  misc_feature (3)..(3): n is 5-[N-(1-naphthylmethyl)carboxyamide]-2'-deoxyuridine
  misc_feature (10)..(11): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (19)..(20): n is 5-[N-(1-naphthylmethyl)carboxyamide]-2'-deoxyuridine
  misc_feature (22)..(22): n is 5-[N-(1-naphthylmethyl)carboxyamide]-2'-deoxyuridine
  misc_feature (27)..(29): n is 5-[N-(1-naphthylmethyl)carboxyamide]-2'-deoxyuridine
  misc_feature (33)..(33): n is 5-[N-(1-naphthylmethyl)carboxyamide]-2'-deoxyuridine
aancagccgnncaagngcnngnaggannnaaanggaa

SEQ ID NO: 558 - DNA, 36 bp, Artificial Sequence
  Synthetic
  misc_feature (2)..(2): n is 5-[N-(1-naphthylmethyl)carboxyamide]-2'-deoxyuridine
  misc_feature (9)..(10): n is 5-[N-(1-naphthylmethyl)carboxyamide]-2'-deoxyuridine
  misc_feature (15)..(15): n is 5-[N-(1-naphthylmethyl)carboxyamide]-2'-deoxyuridine
  misc_feature (18)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (26)..(28): n is 5-[N-(1-naphthylmethyl)carboxyamide]-2'-deoxyuridine
  misc_feature (32)..(32): n is 5-[N-(1-naphthylmethyl)carboxyamide]-2'-deoxyuridine
ancagccgnncaagngcnngnaggannnaaanggaa

SEQ ID NO: 559 - DNA, 35 bp, Artificial Sequence
  Synthetic
  misc_feature (1)..(1): n is 5-[N-(1-naphthylmethyl)carboxyamide]-2'-deoxyuridine
  misc_feature (8)..(9): n is 5-[N-(1-naphthylmethyl)carboxyamide]-2'-deoxyuridine
  misc_feature (14)..(14): n is 5-[N-(1-naphthylmethyl)carboxyamide]-2'-deoxyuridine
  misc_feature (17)..(18): n is 5-[N-(1-naphthylmethyl)carboxyamide]-2'-deoxyuridine
  misc_feature (20)..(20): n is 5-[N-(1-naphthylmethyl)carboxyamide]-2'-deoxyuridine
  misc_feature (25)..(27): n is 5-[N-(1-naphthylmethyl)carboxyamide]-2'-deoxyuridine
  misc_feature (31)..(31): n is 5-[N-(1-naphthylmethyl)carboxyamide]-2'-deoxyuridine
ncagccgnncaagngcnngnaggannnaaanggaa

SEQ ID NO: 560 - DNA, 34 bp, Artificial Sequence
  Synthetic
  misc_feature (7)..(8): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (16)..(17): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (24)..(26): n is 5-[N-(1-naphthylmethyl)carboxyamide]-2'-deoxyuridine
  misc_feature (30)..(30): n is 5-[N-(1-naphthylmethyl)carboxyamide]-2'-deoxyuridine
cagccgnncaagngcnngnaggannnaaanggaa

SEQ ID NO: 561 - DNA, 33 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agccgnncaagngcnngnaggannnaaanggaa

SEQ ID NO: 562 - DNA, 37 bp, Artificial Sequence
  Synthetic
  misc_feature (4)..(4): n is 5-[N-(1-naphthylmethyl)carboxyamide]-2'-deoxyuridine
  misc_feature (11)..(12): n is 5-[N-(1-naphthylmethyl)carboxyamide]-2'-deoxyuridine
  misc_feature (17)..(17): n is 5-[N-(1-naphthylmethyl)carboxyamide]-2'-deoxyuridine
  misc_feature (20)..(21): n is 5-[N-(1-naphthylmethyl)carboxyamide]-2'-deoxyuridine
  misc_feature (23)..(23): n is 5-[N-(1-naphthylmethyl)carboxyamide]-2'-deoxyuridine
  misc_feature (28)..(30): n is 5-[N-(1-naphthylmethyl)carboxyamide]-2'-deoxyuridine
  misc_feature (34)..(34): n is 5-[N-(1-naphthylmethyl)carboxyamide]-2'-deoxyuridine
caancagccgnncaagngcnngnaggannnaaangga

SEQ ID NO: 563 - DNA, 36 bp, Artificial Sequence
  Synthetic
  misc_feature (3)..(3): n is 5-[N-(1-naphthylmethyl)carboxyamide]-2'-deoxyuridine
  misc_feature (10)..(11): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (19)..(20): n is 5-[N-(1-naphthylmethyl)carboxyamide]-2'-deoxyuridine
  misc_feature (22)..(22): n is 5-[N-(1-naphthylmethyl)carboxyamide]-2'-deoxyuridine
  misc_feature (27)..(29): n is 5-[N-(1-naphthylmethyl)carboxyamide]-2'-deoxyuridine
  misc_feature (33)..(33): n is 5-[N-(1-naphthylmethyl)carboxyamide]-2'-deoxyuridine
aancagccgnncaagngcnngnaggannnaaangga

SEQ ID NO: 564 - DNA, 35 bp, Artificial Sequence
  Synthetic
  misc_feature (2)..(2): n is 5-[N-(1-naphthylmethyl)carboxyamide]-2'-deoxyuridine
  misc_feature (9)..(10): n is 5-[N-(1-naphthylmethyl)carboxyamide]-2'-deoxyuridine
  misc_feature (15)..(15): n is 5-[N-(1-naphthylmethyl)carboxyamide]-2'-deoxyuridine
  misc_feature (18)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (26)..(28): n is 5-[N-(1-naphthylmethyl)carboxyamide]-2'-deoxyuridine
  misc_feature (32)..(32): n is 5-[N-(1-naphthylmethyl)carboxyamide]-2'-deoxyuridine
ancagccgnncaagngcnngnaggannnaaangga

SEQ ID NO: 565 - DNA, 34 bp, Artificial Sequence
  Synthetic
  misc_feature (1)..(1): n is 5-[N-(1-naphthylmethyl)carboxyamide]-2'-deoxyuridine
  misc_feature (8)..(9): n is 5-[N-(1-naphthylmethyl)carboxyamide]-2'-deoxyuridine
  misc_feature (14)..(14): n is 5-[N-(1-naphthylmethyl)carboxyamide]-2'-deoxyuridine
  misc_feature (17)..(18): n is 5-[N-(1-naphthylmethyl)carboxyamide]-2'-deoxyuridine
  misc_feature (20)..(20): n is 5-[N-(1-naphthylmethyl)carboxyamide]-2'-deoxyuridine
  misc_feature (25)..(27): n is 5-[N-(1-naphthylmethyl)carboxyamide]-2'-deoxyuridine
  misc_feature (31)..(31): n is 5-[N-(1-naphthylmethyl)carboxyamide]-2'-deoxyuridine
ncagccgnncaagngcnngnaggannnaaangga

SEQ ID NO: 566 - DNA, 33 bp, Artificial Sequence
  Synthetic
  misc_feature (7)..(8): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (16)..(17): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (24)..(26): n is 5-[N-(1-naphthylmethyl)carboxyamide]-2'-deoxyuridine
  misc_feature (30)..(30): n is 5-[N-(1-naphthylmethyl)carboxyamide]-2'-deoxyuridine
cagccgnncaagngcnngnaggannnaaangga

SEQ ID NO: 567 - DNA, 32 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agccgnncaagngcnngnaggannnaaangga

SEQ ID NO: 568 - DNA, 32 bp, Artificial Sequence
  Synthetic
  misc_feature (7)..(8): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (16)..(17): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (24)..(26): n is 5-[N-(1-naphthylmethyl)carboxyamide]-2'-deoxyuridine
  misc_feature (30)..(30): n is 5-[N-(1-naphthylmethyl)carboxyamide]-2'-deoxyuridine
cagccgnncaagngcnngnaggannnaaangg

SEQ ID NO: 569 - DNA, 31 bp, Artificial Sequence
  Synthetic
  misc_feature (7)..(8): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (16)..(17): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (24)..(26): n is 5-[N-(1-naphthylmethyl)carboxyamide]-2'-deoxyuridine
  misc_feature (30)..(30): n is 5-[N-(1-naphthylmethyl)carboxyamide]-2'-deoxyuridine
cagccgnncaagngcnngnaggannnaaang

SEQ ID NO: 570 - DNA, 30 bp, Artificial Sequence
  Synthetic
  misc_feature (7)..(8): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (16)..(17): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (24)..(26): n is 5-[N-(1-naphthylmethyl)carboxyamide]-2'-deoxyuridine
  misc_feature (30)..(30): n is 5-[N-(1-naphthylmethyl)carboxyamide]-2'-deoxyuridine
cagccgnncaagngcnngnaggannnaaan

SEQ ID NO: 571 - DNA, 29 bp, Artificial Sequence
  Synthetic
  misc_feature (7)..(8): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (16)..(17): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (24)..(26): n is 5-[N-(1-naphthylmethyl)carboxyamide]-2'-deoxyuridine
cagccgnncaagngcnngnaggannnaaa

SEQ ID NO: 572 - DNA, 28 bp, Artificial Sequence
  Synthetic
  misc_feature (7)..(8): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (16)..(17): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (24)..(26): n is 5-[N-(1-naphthylmethyl)carboxyamide]-2'-deoxyuridine
cagccgnncaagngcnngnaggannnaa

SEQ ID NO: 573 - DNA, 27 bp, Artificial Sequence
  Synthetic
  misc_feature (7)..(8): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (16)..(17): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (24)..(26): n is 5-[N-(1-naphthylmethyl)carboxyamide]-2'-deoxyuridine
cagccgnncaagngcnngnaggannna

SEQ ID NO: 574 - DNA, 26 bp, Artificial Sequence
  Synthetic
  misc_feature (7)..(8): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (16)..(17): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (24)..(26): n is 5-[N-(1-naphthylmethyl)carboxyamide]-2'-deoxyuridine
cagccgnncaagngcnngnaggannn

SEQ ID NO: 575 - DNA, 31 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agccgnncaagngcnngnaggannnaaangg

SEQ ID NO: 576 - DNA, 30 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agccgnncaagngcnngnaggannnaaang

SEQ ID NO: 577 - DNA, 29 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agccgnncaagngcnngnaggannnaaan

SEQ ID NO: 578 - DNA, 28 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
agccgnncaagngcnngnaggannnaaa

SEQ ID NO: 579 - DNA, 27 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
agccgnncaagngcnngnaggannnaa

SEQ ID NO: 580 - DNA, 26 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
agccgnncaagngcnngnaggannna

SEQ ID NO: 581 - DNA, 25 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
agccgnncaagngcnngnaggannn

SEQ ID NO: 582 - DNA, 31 bp, Artificial Sequence
  Synthetic
  misc_feature (5)..(6): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (14)..(15): n is 5-[N-(1-naphthylmethyl)carboxyamide]-2'-deoxyuridine
  misc_feature (17)..(17): n is 5-[N-(1-naphthylmethyl)carboxyamide]-2'-deoxyuridine
  misc_feature (22)..(24): n is 5-[N-(1-naphthylmethyl)carboxyamide]-2'-deoxyuridine
  misc_feature (28)..(28): n is 5-[N-(1-naphthylmethyl)carboxyamide]-2'-deoxyuridine
gccgnncaagngcnngnaggannnaaangga

SEQ ID NO: 583 - DNA, 30 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnncaagngcnngnaggannnaaangga

SEQ ID NO: 584 - DNA, 29 bp, Artificial Sequence
  Synthetic
  misc_feature (3)..(4): n is 5-[N-(1-naphthylmethyl)carboxyamide]-2'-deoxyuridine
  misc_feature (9)..(9): n is 5-[N-(1-naphthylmethyl)carboxyamide]-2'-deoxyuridine
  misc_feature (12)..(13): n is 5-[N-(1-naphthylmethyl)carboxyamide]-2'-deoxyuridine
  misc_feature (15)..(15): n is 5-[N-(1-naphthylmethyl)carboxyamide]-2'-deoxyuridine
  misc_feature (20)..(22): n is 5-[N-(1-naphthylmethyl)carboxyamide]-2'-deoxyuridine
  misc_feature (26)..(26): n is 5-[N-(1-naphthylmethyl)carboxyamide]-2'-deoxyuridine
cgnncaagngcnngnaggannnaaangga

SEQ ID NO: 585 - DNA, 28 bp, Artificial Sequence
  Synthetic
  misc_feature (2)..(3): n is 5-[N-(1-naphthylmethyl)carboxyamide]-2'-deoxyuridine
  misc_feature (8)..(8): n is 5-[N-(1-naphthylmethyl)carboxyamide]-2'-deoxyuridine
  misc_feature (11)..(12): n is 5-[N-(1-naphthylmethyl)carboxyamide]-2'-deoxyuridine
  misc_feature (14)..(14): n is 5-[N-(1-naphthylmethyl)carboxyamide]-2'-deoxyuridine
  misc_feature (19)..(21): n is 5-[N-(1-naphthylmethyl)carboxyamide]-2'-deoxyuridine
  misc_feature (25)..(25): n is 5-[N-(1-naphthylmethyl)carboxyamide]-2'-deoxyuridine
gnncaagngcnngnaggannnaaangga

SEQ ID NO: 586 - DNA, 29 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnncaagngcnngnaggannnaaangg

SEQ ID NO: 587 - DNA, 30 bp, Artificial Sequence
  Synthetic
  misc_feature (5)..(6): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (14)..(15): n is 5-[N-(1-naphthylmethyl)carboxyamide]-2'-deoxyuridine
  misc_feature (17)..(17): n is 5-[N-(1-naphthylmethyl)carboxyamide]-2'-deoxyuridine
  misc_feature (22)..(24): n is 5-[N-(1-naphthylmethyl)carboxyamide]-2'-deoxyuridine
  misc_feature (28)..(28): n is 5-[N-(1-naphthylmethyl)carboxyamide]-2'-deoxyuridine
gccgnncaagngcnngnaggannnaaangg

SEQ ID NO: 588 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancagccgnncaagngcnngnaggannnaaanggaannggagga

SEQ ID NO: 589 - DNA, 50 bp, Artificial Sequence
  Synthetic
  misc_feature (1)..(1): n is 1,3-propane diol
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ncctccancagccgnncaagngcnngnaggannnaaanggaannggagga

SEQ ID NO: 590 - DNA, 50 bp, Artificial Sequence
  Synthetic
  misc_feature (2)..(2): n is 1,3-propane diol
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
cnctccancagccgnncaagngcnngnaggannnaaanggaannggagga

SEQ ID NO: 591 - DNA, 50 bp, Artificial Sequence
  Synthetic
  misc_feature (3)..(3): n is 1,3-propane diol
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccntccancagccgnncaagngcnngnaggannnaaanggaannggagga

SEQ ID NO: 592 - DNA, 50 bp, Artificial Sequence
  Synthetic
  misc_feature (4)..(4): n is 1,3-propane diol
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
cccnccancagccgnncaagngcnngnaggannnaaanggaannggagga

SEQ ID NO: 593 - DNA, 50 bp, Artificial Sequence
  Synthetic
  misc_feature (5)..(5): n is 1,3-propane diol
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctncancagccgnncaagngcnngnaggannnaaanggaannggagga

SEQ ID NO: 594 - DNA, 50 bp, Artificial Sequence
  Synthetic
  misc_feature (6)..(6): n is 1,3-propane diol
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctcnancagccgnncaagngcnngnaggannnaaanggaannggagga

SEQ ID NO: 595 - DNA, 50 bp, Artificial Sequence
  Synthetic
  misc_feature (7)..(7): n is 1,3-propane diol
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccnncagccgnncaagngcnngnaggannnaaanggaannggagga

SEQ ID NO: 596 - DNA, 50 bp, Artificial Sequence; identical to SEQ ID NO: 588
  Synthetic
  misc_feature (8)..(8): n is 1,3-propane diol
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine

SEQ ID NO: 597 - DNA, 50 bp, Artificial Sequence
  Synthetic
  misc_feature (8)..(8): n is 5-[N-(1-naphthylmethyl)carboxyamide]-2'-deoxyuridine
  misc_feature (9)..(9): n is 1,3-propane diol
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccannagccgnncaagngcnngnaggannnaaanggaannggagga

SEQ ID NO: 598 - DNA, 50 bp, Artificial Sequence
  Synthetic
  misc_feature (8)..(8): n is 5-[N-(1-naphthylmethyl)carboxyamide]-2'-deoxyuridine
  misc_feature (10)..(10): n is 1,3-propane diol
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancngccgnncaagngcnngnaggannnaaanggaannggagga

SEQ ID NO: 599 - DNA, 50 bp, Artificial Sequence
  Synthetic
  misc_feature (8)..(8): n is 5-[N-(1-naphthylmethyl)carboxyamide]-2'-deoxyuridine
  misc_feature (11)..(11): n is 1,3-propane diol
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancanccgnncaagngcnngnaggannnaaanggaannggagga

SEQ ID NO: 600 - DNA, 50 bp, Artificial Sequence
  Synthetic
  misc_feature (8)..(8): n is 5-[N-(1-naphthylmethyl)carboxyamide]-2'-deoxyuridine
  misc_feature (12)..(12): n is 1,3-propane diol
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancagncgnncaagngcnngnaggannnaaanggaannggagga

SEQ ID NO: 601 - DNA, 50 bp, Artificial Sequence
  Synthetic
  misc_feature (8)..(8): n is 5-[N-(1-naphthylmethyl)carboxyamide]-2'-deoxyuridine
  misc_feature (13)..(13): n is 1,3-propane diol
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancagcngnncaagngcnngnaggannnaaanggaannggagga

SEQ ID NO: 602 - DNA, 50 bp, Artificial Sequence
  Synthetic
  misc_feature (8)..(8): n is 5-[N-(1-naphthylmethyl)carboxyamide]-2'-deoxyuridine
  misc_feature (14)..(14): n is 1,3-propane diol
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancagccnnncaagngcnngnaggannnaaanggaannggagga

SEQ ID NO: 603 - DNA, 50 bp, Artificial Sequence; identical to SEQ ID NO: 588
  Synthetic
  misc_feature (8)..(8): n is 5-[N-(1-naphthylmethyl)carboxyamide]-2'-deoxyuridine
  misc_feature (15)..(15): n is 1,3-propane diol
  misc_feature (16)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine

SEQ ID NO: 604 - DNA, 50 bp, Artificial Sequence; identical to SEQ ID NO: 588
  Synthetic
  misc_feature (8)..(8): n is 5-[N-(1-naphthylmethyl)carboxyamide]-2'-deoxyuridine
  misc_feature (15)..(15): n is 5-[N-(1-naphthylmethyl)carboxyamide]-2'-deoxyuridine
  misc_feature (16)..(16): n is 1,3-propane diol
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine

SEQ ID NO: 605 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (17)..(17): n is 1,3-propane diol
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancagccgnnnaagngcnngnaggannnaaanggaannggagga

SEQ ID NO: 606 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 1,3-propane diol
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancagccgnncnagngcnngnaggannnaaanggaannggagga

SEQ ID NO: 607 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (19)..(19): n is 1,3-propane diol
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancagccgnncangngcnngnaggannnaaanggaannggagga

SEQ ID NO: 608 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (20)..(20): n is 1,3-propane diol
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancagccgnncaanngcnngnaggannnaaanggaannggagga

SEQ ID NO: 609 - DNA, 50 bp, Artificial Sequence; identical to SEQ ID NO: 588
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 1,3-propane diol
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine

SEQ ID NO: 610 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (22)..(22): n is 1,3-propane diol
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancagccgnncaagnncnngnaggannnaaanggaannggagga

SEQ ID NO: 611 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (23)..(23): n is 1,3-propane diol
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancagccgnncaagngnnngnaggannnaaanggaannggagga

SEQ ID NO: 612 - DNA, 50 bp, Artificial Sequence; identical to SEQ ID NO: 588
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(24): n is 1,3-propane diol
  misc_feature (25)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine

SEQ ID NO: 613 - DNA, 50 bp, Artificial Sequence; identical to SEQ ID NO: 588
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(24): n is 5-[N-(1-naphthylmethyl)carboxyamide]-2'-deoxyuridine
  misc_feature (25)..(25): n is 1,3-propane diol
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine

SEQ ID NO: 614 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (26)..(26): n is 1,3-propane diol
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancagccgnncaagngcnnnnaggannnaaanggaannggagga

SEQ ID NO: 615 - DNA, 50 bp, Artificial Sequence; identical to SEQ ID NO: 588
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 1,3-propane diol
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine

SEQ ID NO: 616 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(28): n is 1,3-propane diol
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancagccgnncaagngcnngnnggannnaaanggaannggagga

SEQ ID NO: 617 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (29)..(29): n is 1,3-propane diol
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancagccgnncaagngcnngnangannnaaanggaannggagga

SEQ ID NO: 618 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (30)..(30): n is 1,3-propane diol
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancagccgnncaagngcnngnagnannnaaanggaannggagga

SEQ ID NO: 619 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (31)..(31): n is 1,3-propane diol
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancagccgnncaagngcnngnaggnnnnaaanggaannggagga

SEQ ID NO: 620 - DNA, 50 bp, Artificial Sequence; identical to SEQ ID NO: 588
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(32): n is 1,3-propane diol
  misc_feature (33)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine

SEQ ID NO: 621 - DNA, 50 bp, Artificial Sequence; identical to SEQ ID NO: 588
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(32): n is 5-[N-(1-naphthylmethyl)carboxyamide]-2'-deoxyuridine
  misc_feature (33)..(33): n is 1,3-propane diol
  misc_feature (34)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine

SEQ ID NO: 622 - DNA, 50 bp, Artificial Sequence; identical to SEQ ID NO: 588
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(33): n is 5-[N-(1-naphthylmethyl)carboxyamide]-2'-deoxyuridine
  misc_feature (34)..(34): n is 1,3-propane diol
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine

SEQ ID NO: 623 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (35)..(35): n is 1,3-propane diol
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancagccgnncaagngcnngnaggannnnaanggaannggagga

SEQ ID NO: 624 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (36)..(36): n is 1,3-propane diol
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancagccgnncaagngcnngnaggannnananggaannggagga

SEQ ID NO: 625 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (37)..(37): n is 1,3-propane diol
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
ccctccancagccgnncaagngcnngnaggannnaannggaannggagga

SEQ ID NO: 626 - DNA, 50 bp, Artificial Sequence; identical to SEQ ID NO: 588
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 1,3-propane diol
  misc_feature (43)..(44): n is 5-[N-(1-naphthylmethyl)carboxyamide]-2'-deoxyuridine

SEQ ID NO: 627 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (39)..(39): n is 1,3-propane diol
  misc_feature (43)..(44): n is 5-[N-(1-naphthylmethyl)carboxyamide]-2'-deoxyuridine
ccctccancagccgnncaagngcnngnaggannnaaanngaannggagga

SEQ ID NO: 628 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (40)..(40): n is 1,3-propane diol
  misc_feature (43)..(44): n is 5-[N-(1-naphthylmethyl)carboxyamide]-2'-deoxyuridine
ccctccancagccgnncaagngcnngnaggannnaaangnaannggagga

SEQ ID NO: 629 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (41)..(41): n is 1,3-propane diol
  misc_feature (43)..(44): n is 5-[N-(1-naphthylmethyl)carboxyamide]-2'-deoxyuridine
ccctccancagccgnncaagngcnngnaggannnaaanggnannggagga

SEQ ID NO: 630 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (42)..(42): n is 1,3-propane diol
  misc_feature (43)..(44): n is 5-[N-(1-naphthylmethyl)carboxyamide]-2'-deoxyuridine
ccctccancagccgnncaagngcnngnaggannnaaanggannnggagga

SEQ ID NO: 631 - DNA, 50 bp, Artificial Sequence; identical to SEQ ID NO: 588
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(43): n is 1,3-propane diol
  misc_feature (44)..(44): n is 5-[N-(1-naphthylmethyl)carboxyamide]-2'-deoxyuridine

SEQ ID NO: 632 - DNA, 50 bp, Artificial Sequence; identical to SEQ ID NO: 588
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(43): n is 5-[N-(1-naphthylmethyl)carboxyamide]-2'-deoxyuridine
  misc_feature (44)..(44): n is 1,3-propane diol

SEQ ID NO: 633 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
  misc_feature (45)..(45): n is 1,3-propane diol
ccctccancagccgnncaagngcnngnaggannnaaanggaannngagga

SEQ ID NO: 634 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
  misc_feature (46)..(46): n is 1,3-propane diol
ccctccancagccgnncaagngcnngnaggannnaaanggaanngnagga

SEQ ID NO: 635 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
  misc_feature (47)..(47): n is 1,3-propane diol
ccctccancagccgnncaagngcnngnaggannnaaanggaannggngga

SEQ ID NO: 636 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
  misc_feature (48)..(48): n is 1,3-propane diol
ccctccancagccgnncaagngcnngnaggannnaaanggaanngganga

SEQ ID NO: 637 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
  misc_feature (49)..(49): n is 1,3-propane diol
ccctccancagccgnncaagngcnngnaggannnaaanggaannggagna

SEQ ID NO: 638 - DNA, 50 bp, Artificial Sequence
  Synthetic
  misc_feature (8)..(8): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (24)..(25): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (32)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (43)..(44): n is 5-[N-(1-naphthylmethyl)carboxyamide]-2'-deoxyuridine
  misc_feature (50)..(50): n is 1,3-propane diol
ccctccancagccgnncaagngcnngnaggannnaaanggaannggaggn

SEQ ID NO: 639 - DNA, 32 bp, Artificial Sequence
  Synthetic
  misc_feature (1)..(1): n is 2'-O-methyl-adenosine
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
ngccgnncaagngcnngnaggannnaaangga

SEQ ID NO: 640 - DNA, 32 bp, Artificial Sequence
  Synthetic
  misc_feature (2)..(2): n is 2'-O-methyl-guanosine
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
anccgnncaagngcnngnaggannnaaangga

SEQ ID NO: 641 - DNA, 32 bp, Artificial Sequence
  Synthetic
  misc_feature (3)..(3): n is 2'-O-methyl-cytidine
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agncgnncaagngcnngnaggannnaaangga

SEQ ID NO: 642 - DNA, 32 bp, Artificial Sequence
  Synthetic
  misc_feature (4)..(4): n is 2'-O-methyl-cytidine
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agcngnncaagngcnngnaggannnaaangga

SEQ ID NO: 643 - DNA, 32 bp, Artificial Sequence
  Synthetic
  misc_feature (5)..(5): n is 2'-O-methyl-guanosine
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agccnnncaagngcnngnaggannnaaangga

SEQ ID NO: 644 - DNA, 32 bp, Artificial Sequence; identical to SEQ ID NO: 567
  Synthetic
  misc_feature (6)..(6): n is 2'-O-methyl-uridine
  misc_feature (7)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine

SEQ ID NO: 645 - DNA, 32 bp, Artificial Sequence; identical to SEQ ID NO: 567
  Synthetic
  misc_feature (6)..(6): n is 5-[N-(1-naphthylmethyl)carboxyamide]-2'-deoxyuridine
  misc_feature (7)..(7): n is 2'-O-methyl-uridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine

SEQ ID NO: 646 - DNA, 32 bp, Artificial Sequence
  Synthetic
  misc_feature (6)..(7): n is 5-[N-(1-naphthylmethyl)carboxyamide]-2'-deoxyuridine
  misc_feature (8)..(8): n is 2'-O-methyl-cytidine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agccgnnnaagngcnngnaggannnaaangga

SEQ ID NO: 647 - DNA, 32 bp, Artificial Sequence
  Synthetic
  misc_feature (6)..(7): n is 5-[N-(1-naphthylmethyl)carboxyamide]-2'-deoxyuridine
  misc_feature (9)..(9): n is 2'-O-methyl-adenosine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agccgnncnagngcnngnaggannnaaangga

SEQ ID NO: 648 - DNA, 32 bp, Artificial Sequence
  Synthetic
  misc_feature (6)..(7): n is 5-[N-(1-naphthylmethyl)carboxyamide]-2'-deoxyuridine
  misc_feature (10)..(10): n is 2'-O-methyl-adenosine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agccgnncangngcnngnaggannnaaangga

SEQ ID NO: 649 - DNA, 32 bp, Artificial Sequence
  Synthetic
  misc_feature (6)..(7): n is 5-[N-(1-naphthylmethyl)carboxyamide]-2'-deoxyuridine
  misc_feature (11)..(11): n is 2'-O-methyl-guanosine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agccgnncaanngcnngnaggannnaaangga

SEQ ID NO: 650 - DNA, 32 bp, Artificial Sequence; identical to SEQ ID NO: 567
  Synthetic
  misc_feature (6)..(7): n is 5-[N-(1-naphthylmethyl)carboxyamide]-2'-deoxyuridine
  misc_feature (12)..(12): n is 2'-O-methyl-uridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine

SEQ ID NO: 651 - DNA, 32 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (13)..(13): n is 2'-O-methyl-guanosine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agccgnncaagnncnngnaggannnaaangga

SEQ ID NO: 652 - DNA, 32 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (14)..(14): n is 2'-O-methyl-cytidine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agccgnncaagngnnngnaggannnaaangga

SEQ ID NO: 653 - DNA, 32 bp, Artificial Sequence; identical to SEQ ID NO: 567
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(15): n is 2'-O-methyl-uridine
  misc_feature (16)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine

SEQ ID NO: 654 - DNA, 32 bp, Artificial Sequence; identical to SEQ ID NO: 567
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(15): n is 5-[N-(1-naphthylmethyl)carboxyamide]-2'-deoxyuridine
  misc_feature (16)..(16): n is 2'-O-methyl-uridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine

SEQ ID NO: 655 - DNA, 32 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (17)..(17): n is 2'-O-methyl-guanosine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agccgnncaagngcnnnnaggannnaaangga

SEQ ID NO: 656 - DNA, 32 bp, Artificial Sequence; identical to SEQ ID NO: 567
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 2'-O-methyl-uridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine

SEQ ID NO: 657 - DNA, 32 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (19)..(19): n is 2'-O-methyl-adenosine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agccgnncaagngcnngnnggannnaaangga

SEQ ID NO: 658 - DNA, 32 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (20)..(20): n is 2'-O-methyl-guanosine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agccgnncaagngcnngnangannnaaangga

SEQ ID NO: 659 - DNA, 32 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (21)..(21): n is 2'-O-methyl-guanosine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agccgnncaagngcnngnagnannnaaangga

SEQ ID NO: 660 - DNA, 32 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (22)..(22): n is 2'-O-methyl-adenosine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agccgnncaagngcnngnaggnnnnaaangga

SEQ ID NO: 661 - DNA, 32 bp, Artificial Sequence; identical to SEQ ID NO: 567
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(23): n is 2'-O-methyl-uridine
  misc_feature (24)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine

SEQ ID NO: 662 - DNA, 32 bp, Artificial Sequence; identical to SEQ ID NO: 567
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(23): n is 5-[N-(1-naphthylmethyl)carboxyamide]-2'-deoxyuridine
  misc_feature (24)..(24): n is 2'-O-methyl-uridine
  misc_feature (25)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine

SEQ ID NO: 663 - DNA, 32 bp, Artificial Sequence; identical to SEQ ID NO: 567
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(24): n is 5-[N-(1-naphthylmethyl)carboxyamide]-2'-deoxyuridine
  misc_feature (25)..(25): n is 2'-O-methyl-uridine
  misc_feature (29)..(29): n is 5-[N-(1-naphthylmethyl)carboxyamide]-2'-deoxyuridine

SEQ ID NO: 664 - DNA, 32 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (26)..(26): n is 2'-O-methyl-adenosine
  misc_feature (29)..(29): n is 5-[N-(1-naphthylmethyl)carboxyamide]-2'-deoxyuridine
agccgnncaagngcnngnaggannnnaangga

SEQ ID NO: 665 - DNA, 32 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (27)..(27): n is 2'-O-methyl-adenosine
  misc_feature (29)..(29): n is 5-[N-(1-naphthylmethyl)carboxyamide]-2'-deoxyuridine
agccgnncaagngcnngnaggannnanangga

SEQ ID NO: 666 - DNA, 32 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (28)..(28): n is 2'-O-methyl-adenosine
  misc_feature (29)..(29): n is 5-[N-(1-naphthylmethyl)carboxyamide]-2'-deoxyuridine
agccgnncaagngcnngnaggannnaanngga

SEQ ID NO: 667 - DNA, 32 bp, Artificial Sequence; identical to SEQ ID NO: 567
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 2'-O-methyl-uridine

SEQ ID NO: 668 - DNA, 32 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
  misc_feature (30)..(30): n is 2'-O-methyl-guanosine
agccgnncaagngcnngnaggannnaaannga

SEQ ID NO: 669 - DNA, 32 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
  misc_feature (31)..(31): n is 2'-O-methyl-guanosine
agccgnncaagngcnngnaggannnaaangna

SEQ ID NO: 670 - DNA, 32 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
  misc_feature (32)..(32): n is 2'-O-methyl-adenosine
agccgnncaagngcnngnaggannnaaanggn

SEQ ID NO: 671 - DNA, 32 bp, Artificial Sequence; identical to SEQ ID NO: 646
  Synthetic
  misc_feature (6)..(7): n is 5-[N-(1-naphthylmethyl)carboxyamide]-2'-deoxyuridine
  misc_feature (8)..(8): n is 1,3-propane diol
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine

SEQ ID NO: 672 - DNA, 32 bp, Artificial Sequence; identical to SEQ ID NO: 655
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (17)..(17): n is 1,3-propane diol
  misc_feature (18)..(18): n is 5-[N-(1-naphthylmethyl)carboxyamide]-2'-deoxyuridine
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine

SEQ ID NO: 673 - DNA, 32 bp, Artificial Sequence; identical to SEQ ID NO: 658
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (20)..(20): n is 1,3-propane diol
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine

SEQ ID NO: 674 - DNA, 32 bp, Artificial Sequence
  Synthetic
  misc_feature (6)..(7): n is 5-[N-(1-naphthylmethyl)carboxyamide]-2'-deoxyuridine
  misc_feature (8)..(8): n is 1,3-propane diol
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (17)..(17): n is 1,3-propane diol
  misc_feature (18)..(18): n is 5-[N-(1-naphthylmethyl)carboxyamide]-2'-deoxyuridine
  misc_feature (20)..(20): n is 1,3-propane diol
  misc_feature (23)..(25): n is 5-[N-(1-naphthylmethyl)carboxyamide]-2'-deoxyuridine
  misc_feature (29)..(29): n is 5-[N-(1-naphthylmethyl)carboxyamide]-2'-deoxyuridine
agccgnnnaagngcnnnnangannnaaangga

SEQ ID NO: 675 - DNA, 31 bp, Artificial Sequence
  Synthetic
  misc_feature (6)..(7): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (14)..(15): n is 5-[N-(1-naphthylmethyl)carboxyamide]-2'-deoxyuridine
  misc_feature (17)..(17): n is 5-[N-(1-naphthylmethyl)carboxyamide]-2'-deoxyuridine
  misc_feature (22)..(24): n is 5-[N-(1-naphthylmethyl)carboxyamide]-2'-deoxyuridine
  misc_feature (28)..(28): n is 5-[N-(1-naphthylmethyl)carboxyamide]-2'-deoxyuridine
agccgnnaagngcnngnaggannnaaangga

SEQ ID NO: 676 - DNA, 31 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (17)..(17): n is 5-[N-(1-naphthylmethyl)carboxyamide]-2'-deoxyuridine
  misc_feature (22)..(24): n is 5-[N-(1-naphthylmethyl)carboxyamide]-2'-deoxyuridine
  misc_feature (28)..(28): n is 5-[N-(1-naphthylmethyl)carboxyamide]-2'-deoxyuridine
agccgnncaagngcnnnaggannnaaangga

SEQ ID NO: 677 - DNA, 31 bp, Artificial Sequence
  Synthetic
  misc_feature (6)..(7): n is 5-[N-(1-naphthylmethyl)carboxyamide]-2'-deoxyuridine
  misc_feature (12)..(12): n is 5-[N-(1-naphthylmethyl)carboxyamide]-2'-deoxyuridine
  misc_feature (15)..(16): n is 5-[N-(1-naphthylmethyl)carboxyamide]-2'-deoxyuridine
  misc_feature (18)..(18): n is 5-[N-(1-naphthylmethyl)carboxyamide]-2'-deoxyuridine
  misc_feature (22)..(24): n is 5-[N-(1-naphthylmethyl)carboxyamide]-2'-deoxyuridine
  misc_feature (28)..(28): n is 5-[N-(1-naphthylmethyl)carboxyamide]-2'-deoxyuridine
agccgnncaagngcnngnagannnaaangga

SEQ ID NO: 678 - DNA, 30 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnnaaagngcnngnaggannnaaangga

SEQ ID NO: 679 - DNA, 30 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnngaagngcnngnaggannnaaangga

SEQ ID NO: 680 - DNA, 30 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnntaagngcnngnaggannnaaangga

SEQ ID NO: 681 - DNA, 30 bp, Artificial Sequence
  Synthetic
  misc_feature (4)..(5): n is 5-[N-(1-nap[hthylmethyl)carboxyamide]-2'-deoxyuridine
  misc_feature (10)..(10): n is 5-[N-(1-nap[hthylmethyl)carboxyamide]-2'-deoxyuridine
  misc_feature (13)..(14): n is 5-[N-(1-nap[hthylmethyl)carboxyamide]-2'-deoxyuridine
  misc_feature (16)..(16): n is 5-[N-(1-nap[hthylmethyl)carboxyamide]-2'-deoxyuridine
  misc_feature (21)..(23): n is 5-[N-(1-nap[hthylmethyl)carboxyamide]-2'-deoxyuridine
  misc_feature (27)..(27): n is 5-[N-(1-nap[hthylmethyl)carboxyamide]-2'-deoxyuridine
ccgnncaagngcnnanaggannnaaangga

SEQ ID NO: 682 - DNA, 30 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnncaagngcnncnaggannnaaangga

SEQ ID NO: 683 - DNA, 30 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnncaagngcnntnaggannnaaangga

SEQ ID NO: 684 - DNA, 30 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnncaagngcnngnaagannnaaangga

SEQ ID NO: 685 - DNA, 30 bp, Artificial Sequence
  Synthetic
  misc_feature (4)..(5): n is 5-[N-(1-naphthylmethyl)carboxyamid[e]-2'-deoxyuridine
  misc_feature (10)..(10): n is 5-[N-(1-naphthylmethyl)carboxyamid[e]-2'-deoxyuridine
  misc_feature (13)..(14): n is 5-[N-(1-naphthylmethyl)carboxyamid[e]-2'-deoxyuridine
  misc_feature (16)..(16): n is 5-[N-(1-naphthylmethyl)carboxyamid[e]-2'-deoxyuridine
  misc_feature (21)..(23): n is 5-[N-(1-naphthylmethyl)carboxyamid[e]-2'-deoxyuridine
  misc_feature (27)..(27): n is 5-[N-(1-naphthylmethyl)carboxyamid[e]-2'-deoxyuridine
ccgnncaagngcnngnacgannnaaangga

SEQ ID NO: 686 - DNA, 30 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnncaagngcnngnatgannnaaangga

SEQ ID NO: 687 - DNA, 29 bp, Artificial Sequence
  Synthetic
  misc_feature (4)..(4): n is 5-[N-(1-naphthylmethyl)carboxyamide]-2'-O-methyl-uridine
  misc_feature (5)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnncaagngcnngnaggannnaaangg

SEQ ID NO: 688 - DNA, 29 bp, Artificial Sequence
  Synthetic
  misc_feature (4)..(4): n is 5-[N-(1-naphthylmethyl)carboxyamide]-2'-deoxyuridine
  misc_feature (5)..(5): n is 5-[N-(1-naphthylmethyl)carboxyamide]-2'-O-methyl-uridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnncaagngcnngnaggannnaaangg

SEQ ID NO: 689 - DNA, 29 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-O-methyl-uridine
  misc_feature (13)..(14): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnncaagngcnngnaggannnaaangg

SEQ ID NO: 690 - DNA, 29 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(13): n is 5-[N-(1-naphthylmethyl)carboxyamide]-2'-O-methyl-uridine
  misc_feature (14)..(14): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnncaagngcnngnaggannnaaangg

SEQ ID NO: 691 - DNA, 29 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (14)..(14): n is 5-[N-(1-naphthylmethyl)carboxyamide]-2'-O-methyl-uridine
  misc_feature (16)..(16): n is 5-[N-(1-naphthylmethyl)carboxyamide]-2'-deoxyuridine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnncaagngcnngnaggannnaaangg

SEQ ID NO: 692 - DNA, 29 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (16)..(16): n is 5-[N-(1-naphthylmethyl)carboxyamide]-2'-O-methyl-uridine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnncaagngcnngnaggannnaaangg

SEQ ID NO: 693 - DNA, 29 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (21)..(21): n is 5-[N-(1-naphthylmethyl)carboxyamide]-2'-O-methyl-uridine
  misc_feature (22)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnncaagngcnngnaggannnaaangg

SEQ ID NO: 694 - DNA, 29 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'-O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnncaagngcnngnaggannnaaangg

SEQ ID NO: 695 - DNA, 29 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (21)..(22): n is 5-[N-(1-naphthylmethyl)carboxyamide]-2'-deoxyuridine
  misc_feature (23)..(23): n is 5-[N-(1-naphthylmethyl)carboxyamide]-2'-O-methyl-uridine
  misc_feature (27)..(27): n is 5-[N-(1-naphthylmethyl)carboxyamide]-2'-deoxyuridine
ccgnncaagngcnngnaggannnaaangg

SEQ ID NO: 696 - DNA, 29 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (16)..(16): n is 5-[N-(1-naphthylmethyl)carboxyamide]-2'-deoxyuridine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'- O-methyl-uridine
ccgnncaagngcnngnaggannnaaangg

SEQ ID NO: 697 - DNA, 29 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (15)..(15): n is 1,3-propane diol
  misc_feature (16)..(16): n is 5-[N-(1-naphthylmethyl)carboxyamide]-2'-deoxyuridine
  misc_feature (18)..(18): n is 1,3-propane diol
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnncaagngcnnnnangannnaaangg

SEQ ID NO: 698 - DNA, 29 bp, Artificial Sequence
  Synthetic
  misc_feature (4)..(5): n is 5-[N-(1-naphthylmethyl)carboxyamide]-2'-deoxyuridine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (15)..(15): n is 1,3-propane diol
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 1,3-propane diol
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnncaanngcnnnnnngannnaaangg

SEQ ID NO: 699 - DNA, 29 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 1,3-propane diol
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 1,3-propane diol
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
ccgnnnaanngnnnnnnngannnaaannn

SEQ ID NO: 700 - DNA, 29 bp, Artificial Sequence
  Synthetic
  misc_feature (1)..(1): n is 2'-O-methyl-cytidine
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 1,3-propane diol
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 1,3-propane diol
  misc_feature (21)..(23): n is 5-[N-(1-naphthylmethyl)carboxyamide]-2'-deoxyuridine
  misc_feature (25)..(25): n is 2'-O-methyl-adenosine
  misc_feature (27)..(27): n is 5-[N-(1-naphthylmethyl)carboxyamide]-2'-deoxyuridine
  misc_feature (28)..(29): n is 2'-O-methyl-guanosine
ncgnnnaanngnnnnnnngannnanannn

SEQ ID NO: 701 - DNA, 29 bp, Artificial Sequence
  Synthetic
  misc_feature (4)..(5): n is 5-[N-(1-naphthylmethyl)carboxyamide]-2'-deoxyuridine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (15)..(15): n is 1,3-propane diol
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
ccgnncaanngcnnnnnggannnaaangg

SEQ ID NO: 702 - DNA, 29 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 1,3-propane diol
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
ccgnnnaanngnnnnnnngannnaaannn

SEQ ID NO: 703 - DNA, 29 bp, Artificial Sequence
  Synthetic
  misc_feature (1)..(1): n is 2'-O-methyl-cytidine
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 1,3-propane diol
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(23): n is 5-[N-(1-naphthylmethyl)carboxyamide]-2'-deoxyuridine
  misc_feature (25)..(25): n is 2'-O-methyl-adenosine
  misc_feature (27)..(27): n is 5-[N-(1-naphthylmethyl)carboxyamide]-2'-deoxyuridine
  misc_feature (28)..(29): n is 2'-O-methyl-guanosine
ncgnnnaanngnnnnnnngannnanannn

SEQ ID NO: 704 - DNA, 29 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 1,3-propane diol
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'-O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
ccgnnnaanngnnnnnnngannnaaannn

SEQ ID NO: 705 - DNA, 29 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
ccgnnnaanngnnnnnnngannnaaannn

SEQ ID NO: 706 - DNA, 29 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'-O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
ccgnnnaanngnnnnnnngannnaaannn

SEQ ID NO: 707 - DNA, 48 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(25): n is 5-(N-benzylcarboxyamide)-2'-deoxyuridine
  misc_feature (26)..(26): n is 5-[N-(3,4-methylenedioxyphenyl-methyl)carboxyamide]-2'-deoxyuridi ne
  misc_feature (27)..(27): n is 2'-O-methyl-adenosine
  misc_feature (29)..(29): n is hexaethylene glycol
  misc_feature (31)..(31): n is 5-(N-benzylcarboxyamide)-2'-O-methyl-uridine
  misc_feature (32)..(32): n is 5-(N-benzylcarboxyamide)-2'-deoxyuridine
  misc_feature (35)..(35): n is 1,3-propane diol
  misc_feature (36)..(36): n is 2'-O-methyl-cytidine
  misc_feature (40)..(41): n is 5-(N-benzylcarboxyamide)-2'-deoxyuridine
  misc_feature (42)..(42): n is 5-(N-benzylcarboxyamide)-2'-O-methyl-uridine
  misc_feature (43)..(43): n is 2'-O-methyl-adenosine
  misc_feature (44)..(44): n is 5-(N-benzylcarboxyamide)-2'-deoxyuridine
  misc_feature (45)..(45): n is 2'-O-methyl-adenosine
  misc_feature (48)..(48): n is 2'-O-methyl-guanosine
nnncngnnacnngcgnnnnnngcnnnncngnnacnngcgnnnnnngcn

SEQ ID NO: 708 - DNA, 49 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(25): n is hexaethylene glycol
  misc_feature (26)..(26): n is 5-(N-benzylcarboxyamide)-2'-deoxyuridine
  misc_feature (27)..(27): n is 5-[N-(3,4-methylenedioxyphenyl-methyl)carboxyamide]-2'-deoxyuridi ne
  misc_feature (28)..(28): n is 2'-O-methyl-adenosine
  misc_feature (30)..(30): n is hexaethylene glycol
  misc_feature (32)..(32): n is 5-(N-benzylcarboxyamide)-2'-O-methyl-uridine
  misc_feature (33)..(33): n is 5-(N-benzylcarboxyamide)-2'-deoxyuridine
  misc_feature (36)..(36): n is 1,3-propane diol
  misc_feature (37)..(37): n is 2'-O-methyl-cytidine
  misc_feature (41)..(42): n is 5-(N-benzylcarboxyamide)-2'-deoxyuridine
  misc_feature (43)..(43): n is 5-(N-benzylcarboxyamide)-2'-O-methyl-uridine
  misc_feature (44)..(44): n is 2'-O-methyl-adenosine
  misc_feature (45)..(45): n is 5-(N-benzylcarboxyamide)-2'-deoxyuridine
  misc_feature (46)..(46): n is 2'-O-methyl-adenosine
  misc_feature (49)..(49): n is 2'-O-methyl-guanosine
nnncngnnacnngcgnnnnnngcnnnnncngnnacnngcgnnnnnngcn

SEQ ID NO: 709 - DNA, 50 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(26): n is hexaethylene glycol
  misc_feature (27)..(27): n is 5-(N-benzylcarboxyamide)-2'-deoxyuridine
  misc_feature (28)..(28): n is 5-[N-(3,4-methylenedioxyphenyl-methyl)carboxyamide]-2'-deoxyuridi ne
  misc_feature (29)..(29): n is 2'-O-methyl-adenosine
  misc_feature (31)..(31): n is hexaethylene glycol
  misc_feature (33)..(33): n is 5-(N-benzylcarboxyamide)-2'-O-methyl-uridine
  misc_feature (34)..(34): n is 5-(N-benzylcarboxyamide)-2'-deoxyuridine
  misc_feature (37)..(37): n is 1,3-propane diol
  misc_feature (38)..(38): n is 2'-O-methyl-cytidine
  misc_feature (42)..(43): n is 5-(N-benzylcarboxyamide)-2'-deoxyuridine
  misc_feature (44)..(44): n is 5-(N-benzylcarboxyamide)-2'-O-methyl-uridine
  misc_feature (45)..(45): n is 2'-O-methyl-adenosine
  misc_feature (46)..(46): n is 5-(N-benzylcarboxyamide)-2'-deoxyuridine
  misc_feature (47)..(47): n is 2'-O-methyl-adenosine
  misc_feature (50)..(50): n is 2'-O-methyl-guanosine
nnncngnnacnngcgnnnnnngcnnnnnncngnnacnngcgnnnnnngcn

SEQ ID NO: 710 - DNA, 51 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(27): n is hexaethylene glycol
  misc_feature (28)..(28): n is 5-(N-benzylcarboxyamide)-2'-deoxyuridine
  misc_feature (29)..(29): n is 5-[N-(3,4-methylenedioxyphenyl-methyl)carboxyamide]-2'-deoxyuridi ne
  misc_feature (30)..(30): n is 2'-O-methyl-adenosine
  misc_feature (32)..(32): n is hexaethylene glycol
  misc_feature (34)..(34): n is 5-(N-benzylcarboxyamide)-2'-O-methyl-uridine
  misc_feature (35)..(35): n is 5-(N-benzylcarboxyamide)-2'-deoxyuridine
  misc_feature (38)..(38): n is 1,3-propane diol
  misc_feature (39)..(39): n is 2'-O-methyl-cytidine
  misc_feature (43)..(44): n is 5-(N-benzylcarboxyamide)-2'-deoxyuridine
  misc_feature (45)..(45): n is 5-(N-benzylcarboxyamide)-2'-O-methyl-uridine
  misc_feature (46)..(46): n is 2'-O-methyl-adenosine
  misc_feature (47)..(47): n is 5-(N-benzylcarboxyamide)-2'-deoxyuridine
  misc_feature (48)..(48): n is 2'-O-methyl-adenosine
  misc_feature (51)..(51): n is 2'-O-methyl-guanosine
nnncngnnacnngcgnnnnnngcnnnnnnncngnnacnngcgnnnnnngcn

SEQ ID NO: 711 - DNA, 52 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(28): n is hexaethylene glycol
  misc_feature (29)..(29): n is 5-(N-benzylcarboxyamide)-2'-deoxyuridine
  misc_feature (30)..(30): n is 5-[N-(3,4-methylenedioxyphenyl-methyl)carboxyamide]-2'-deoxyuridi ne
  misc_feature (31)..(31): n is 2'-O-methyl-adenosine
  misc_feature (33)..(33): n is hexaethylene glycol
  misc_feature (35)..(35): n is 5-(N-benzylcarboxyamide)-2'-O-methyl-uridine
  misc_feature (36)..(36): n is 5-(N-benzylcarboxyamide)-2'-deoxyuridine
  misc_feature (39)..(39): n is 1,3-propane diol
  misc_feature (40)..(40): n is 2'-O-methyl-cytidine
  misc_feature (44)..(45): n is 5-(N-benzylcarboxyamide)-2'-deoxyuridine
  misc_feature (46)..(46): n is 5-(N-benzylcarboxyamide)-2'-O-methyl-uridine
  misc_feature (47)..(47): n is 2'-O-methyl-adenosine
  misc_feature (48)..(48): n is 5-(N-benzylcarboxyamide)-2'-deoxyuridine
  misc_feature (49)..(49): n is 2'-O-methyl-adenosine
  misc_feature (52)..(52): n is 2'-O-methyl-guanosine
nnncngnnacnngcgnnnnnngcnnnnnnnncngnnacnngcgnnnnnngcn

SEQ ID NO: 712 - DNA, 53 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(29): n is hexaethylene glycol
  misc_feature (30)..(30): n is 5-(N-benzylcarboxyamide)-2'-deoxyuridine
  misc_feature (31)..(31): n is 5-[N-(3,4-methylenedioxyphenyl-methyl)carboxyamide]-2'-deoxyuridi ne
  misc_feature (32)..(32): n is 2'-O-methyl-adenosine
  misc_feature (34)..(34): n is hexaethylene glycol
  misc_feature (36)..(36): n is 5-(N-benzylcarboxyamide)-2'-O-methyl-uridine
  misc_feature (37)..(37): n is 5-(N-benzylcarboxyamide)-2'-deoxyuridine
  misc_feature (40)..(40): n is 1,3-propane diol
  misc_feature (41)..(41): n is 2'-O-methyl-cytidine
  misc_feature (45)..(46): n is 5-(N-benzylcarboxyamide)-2'-deoxyuridine
  misc_feature (47)..(47): n is 5-(N-benzylcarboxyamide)-2'-O-methyl-uridine
  misc_feature (48)..(48): n is 2'-O-methyl-adenosine
  misc_feature (49)..(49): n is 5-(N-benzylcarboxyamide)-2'-deoxyuridine
  misc_feature (50)..(50): n is 2'-O-methyl-adenosine
  misc_feature (53)..(53): n is 2'-O-methyl-guanosine
nnncngnnacnngcgnnnnnngcnnnnnnnnncngnnacnngcgnnnnnngcn

SEQ ID NO: 713 - DNA, 54 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(30): n is hexaethylene glycol
  misc_feature (31)..(31): n is 5-(N-benzylcarboxyamide)-2'-deoxyuridine
  misc_feature (32)..(32): n is 5-[N-(3,4-methylenedioxyphenyl-methyl)carboxyamide]-2'-deoxyuridi ne
  misc_feature (33)..(33): n is 2'-O-methyl-adenosine
  misc_feature (35)..(35): n is hexaethylene glycol
  misc_feature (37)..(37): n is 5-(N-benzylcarboxyamide)-2'-O-methyl-uridine
  misc_feature (38)..(38): n is 5-(N-benzylcarboxyamide)-2'-deoxyuridine
  misc_feature (41)..(41): n is 1,3-propane diol
  misc_feature (42)..(42): n is 2'-O-methyl-cytidine
  misc_feature (46)..(47): n is 5-(N-benzylcarboxyamide)-2'-deoxyuridine
  misc_feature (48)..(48): n is 5-(N-benzylcarboxyamide)-2'-O-methyl-uridine
  misc_feature (49)..(49): n is 2'-O-methyl-adenosine
  misc_feature (50)..(50): n is 5-(N-benzylcarboxyamide)-2'-deoxyuridine
  misc_feature (51)..(51): n is 2'-O-methyl-adenosine
  misc_feature (54)..(54): n is 2'-O-methyl-guanosine
nnncngnnacnngcgnnnnnngcnnnnnnnnnncngnnacnngcgnnnnnngcn

SEQ ID NO: 714 - DNA, 48 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(25): n is 2'-O-methyl-guanosine
  misc_feature (28)..(28): n is 2'-O-methyl-adenosine
  misc_feature (29)..(29): n is 5-(N-benzylcarboxyamide)-2'-deoxyuridine
  misc_feature (30)..(30): n is 2'-O-methyl-adenosine
  misc_feature (31)..(31): n is 5-(N-benzylcarboxyamide)-2'-O-methyl-uridine
  misc_feature (32)..(33): n is 5-(N-benzylcarboxyamide)-2'-deoxyuridine
  misc_feature (37)..(37): n is 2'-O-methyl-cytidine
  misc_feature (38)..(38): n is 1,3-propane diol
  misc_feature (41)..(41): n is 5-(N-benzylcarboxyamide)-2'-deoxyuridine
  misc_feature (42)..(42): n is 5-(N-benzylcarboxyamide)-2'-O-methyl-uridine
  misc_feature (44)..(44): n is hexaethylene glycol
  misc_feature (46)..(46): n is 2'-O-methyl-adenosine
  misc_feature (47)..(47): n is 5-[N-(3,4-methylenedioxyphenyl-methyl)carboxyamide]-2'-deoxyuridi ne
  misc_feature (48)..(48): n is 5-(N-benzylcarboxyamide)-2'-deoxyuridine
nnncngnnacnngcgnnnnnngcnncgnnnnnngcgnncanngncnnn

SEQ ID NO: 715 - DNA, 50 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(26): n is hexaethylene glycol
  misc_feature (27)..(27): n is 2'-O-methyl-guanosine
  misc_feature (30)..(30): n is 2'-O-methyl-adenosine
  misc_feature (31)..(31): n is 5-(N-benzylcarboxyamide)-2'-deoxyuridine
  misc_feature (32)..(32): n is 2'-O-methyl-adenosine
  misc_feature (33)..(33): n is 5-(N-benzylcarboxyamide)-2'-O-methyl-uridine
  misc_feature (34)..(35): n is 5-(N-benzylcarboxyamide)-2'-deoxyuridine
  misc_feature (39)..(39): n is 2'-O-methyl-cytidine
  misc_feature (40)..(40): n is 1,3-propane diol
  misc_feature (43)..(43): n is 5-(N-benzylcarboxyamide)-2'-deoxyuridine
  misc_feature (44)..(44): n is 5-(N-benzylcarboxyamide)-2'-O-methyl-uridine
  misc_feature (46)..(46): n is hexaethylene glycol
  misc_feature (48)..(48): n is 2'-O-methyl-adenosine
  misc_feature (49)..(49): n is 5-[N-(3,4-methylenedioxyphenyl-methyl)carboxyamide]-2'-deoxyuridi ne
  misc_feature (50)..(50): n is 5-(N-benzylcarboxyamide)-2'-deoxyuridine
nnncngnnacnngcgnnnnnngcnnnncgnnnnnngcgnncanngncnnn

SEQ ID NO: 716 - DNA, 52 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(28): n is hexaethylene glycol
  misc_feature (29)..(29): n is 2'-O-methyl-guanosine
  misc_feature (32)..(32): n is 2'-O-methyl-adenosine
  misc_feature (33)..(33): n is 5-(N-benzylcarboxyamide)-2'-deoxyuridine
  misc_feature (34)..(34): n is 2'-O-methyl-adenosine
  misc_feature (35)..(35): n is 5-(N-benzylcarboxyamide)-2'-O-methyl-uridine
  misc_feature (36)..(37): n is 5-(N-benzylcarboxyamide)-2'-deoxyuridine
  misc_feature (41)..(41): n is 2'-O-methyl-cytidine
  misc_feature (42)..(42): n is 1,3-propane diol
  misc_feature (45)..(45): n is 5-(N-benzylcarboxyamide)-2'-deoxyuridine
  misc_feature (46)..(46): n is 5-(N-benzylcarboxyamide)-2'-O-methyl-uridine
  misc_feature (48)..(48): n is hexaethylene glycol
  misc_feature (50)..(50): n is 2'-O-methyl-adenosine
  misc_feature (51)..(51): n is 5-[N-(3,4-methylenedioxyphenyl-methyl)carboxyamide]-2'-deoxyuridi ne
  misc_feature (52)..(52): n is 5-(N-benzylcarboxyamide)-2'-deoxyuridine
nnncngnnacnngcgnnnnnngcnnnnnncgnnnnnngcgnncanngncnnn

SEQ ID NO: 717 - DNA, 54 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(30): n is hexaethylene glycol
  misc_feature (31)..(31): n is 2'-O-methyl-guanosine
  misc_feature (34)..(34): n is 2'-O-methyl-adenosine
  misc_feature (35)..(35): n is 5-(N-benzylcarboxyamide)-2'-deoxyuridine
  misc_feature (36)..(36): n is 2'-O-methyl-adenosine
  misc_feature (37)..(37): n is 5-(N-benzylcarboxyamide)-2'-O-methyl-uridine
  misc_feature (38)..(39): n is 5-(N-benzylcarboxyamide)-2'-deoxyuridine
  misc_feature (43)..(43): n is 2'-O-methyl-cytidine
  misc_feature (44)..(44): n is 1,3-propane diol
  misc_feature (47)..(47): n is 5-(N-benzylcarboxyamide)-2'-deoxyuridine
  misc_feature (48)..(48): n is 5-(N-benzylcarboxyamide)-2'-O-methyl-uridine
  misc_feature (50)..(50): n is hexaethylene glycol
  misc_feature (52)..(52): n is 2'-O-methyl-adenosine
  misc_feature (53)..(53): n is 5-[N-(3,4-methylenedioxyphenyl-methyl)carboxyamide]-2'-deoxyuridi ne
  misc_feature (54)..(54): n is 5-(N-benzylcarboxyamide)-2'-deoxyuridine
nnncngnnacnngcgnnnnnngcnnnnnnnncgnnnnnngcgnncanngncnnn

SEQ ID NO: 718 - DNA, 42 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (30)..(30): n is 5-[N-(1-naphthylmethyl)carboxyamide]-2'-deoxyuridine
  misc_feature (32)..(32): n is 5-[N-(1-naphthylmethyl)carboxyamide]-2'-deoxyuridine
  misc_feature (34)..(34): n is 5-[N-(1-naphthylmethyl)carboxyamide]-2'-deoxyuridine
  misc_feature (40)..(40): n is 5-[N-(1-naphthylmethyl)carboxyamide]-2'-deoxyuridine
  misc_feature (42)..(42): n is 5-[N-(1-naphthylmethyl)carboxyamide]-2'-deoxyuridine
cgacagcangnangcacancncgacagcangnangcacancn

SEQ ID NO: 719 - DNA, 43 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (22)..(22): n is hexaethylene glycol
  misc_feature (31)..(31): n is 5-[N-(1-naphthylmethyl)carboxyamide]-2'-deoxyuridine
  misc_feature (33)..(33): n is 5-[N-(1-naphthylmethyl)carboxyamide]-2'-deoxyuridine
  misc_feature (35)..(35): n is 5-[N-(1-naphthylmethyl)carboxyamide]-2'-deoxyuridine
  misc_feature (41)..(41): n is 5-[N-(1-naphthylmethyl)carboxyamide]-2'-deoxyuridine
  misc_feature (43)..(43): n is 5-[N-(1-naphthylmethyl)carboxyamide]-2'-deoxyuridine
cgacagcangnangcacancnncgacagcangnangcacancn

SEQ ID NO: 720 - DNA, 44 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (22)..(23): n is hexaethylene glycol
  misc_feature (32)..(32): n is 5-[N-(1-naphthylmethyl)carboxyamide]-2'-deoxyuridine
  misc_feature (34)..(34): n is 5-[N-(1-naphthylmethyl)carboxyamide]-2'-deoxyuridine
  misc_feature (36)..(36): n is 5-[N-(1-naphthylmethyl)carboxyamide]-2'-deoxyuridine
  misc_feature (42)..(42): n is 5-[N-(1-naphthylmethyl)carboxyamide]-2'-deoxyuridine
  misc_feature (44)..(44): n is 5-[N-(1-naphthylmethyl)carboxyamide]-2'-deoxyuridine
cgacagcangnangcacancnnncgacagcangnangcacancn

SEQ ID NO: 721 - DNA, 45 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (22)..(24): n is hexaethylene glycol
  misc_feature (33)..(33): n is 5-[N-(1-naphthylmethyl)carboxyamide]-2'-deoxyuridine
  misc_feature (35)..(35): n is 5-[N-(1-naphthylmethyl)carboxyamide]-2'-deoxyuridine
  misc_feature (37)..(37): n is 5-[N-(1-naphthylmethyl)carboxyamide]-2'-deoxyuridine
  misc_feature (43)..(43): n is 5-[N-(1-naphthylmethyl)carboxyamide]-2'-deoxyuridine
  misc_feature (45)..(45): n is 5-[N-(1-naphthylmethyl)carboxyamide]-2'-deoxyuridine
cgacagcangnangcacancnnnncgacagcangnangcacancn

SEQ ID NO: 722 - DNA, 46 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (22)..(25): n is hexaethylene glycol
  misc_feature (34)..(34): n is 5-[N-(1-naphthylmethyl)carboxyamide]-2'-deoxyuridine
  misc_feature (36)..(36): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (44)..(44): n is 5-[N-(1-naphthylmethyl)carboxyamide]-2'-deoxyuridine
  misc_feature (46)..(46): n is 5-[N-(1-naphthylmethyl)carboxyamide]-2'-deoxyuridine
cgacagcangnangcacancnnnnncgacagcangnangcacancn

SEQ ID NO: 723 - DNA, 47 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (22)..(26): n is hexaethylene glycol
  misc_feature (35)..(35): n is 5-[N-(1-naphthylmethyl)carboxyamide]-2'-deoxyuridine
  misc_feature (37)..(37): n is 5-[N-(1-naphthylmethyl)carboxyamide]-2'-deoxyuridine
  misc_feature (39)..(39): n is 5-[N-(1-naphthylmethyl)carboxyamide]-2'-deoxyuridine
  misc_feature (45)..(45): n is 5-[N-(1-naphthylmethyl)carboxyamide]-2'-deoxyuridine
  misc_feature (47)..(47): n is 5-[N-(1-naphthylmethyl)carboxyamide]-2'-deoxyuridine
cgacagcangnangcacancnnnnnncgacagcangnangcacancn

SEQ ID NO: 724 - DNA, 48 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (22)..(27): n is hexaethylene glycol
  misc_feature (36)..(36): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (40)..(40): n is 5-[N-(1-naphthylmethyl)carboxyamide]-2'-deoxyuridine
  misc_feature (46)..(46): n is 5-[N-(1-naphthylmethyl)carboxyamide]-2'-deoxyuridine
  misc_feature (48)..(48): n is 5-[N-(1-naphthylmethyl)carboxyamide]-2'-deoxyuridine
cgacagcangnangcacancnnnnnnncgacagcangnangcacancn

SEQ ID NO: 725 - DNA, 42 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(22): n is 5-[N-(1-naphthylmethyl)carboxyamide]-2'-deoxyuridine
  misc_feature (24)..(24): n is 5-[N-(1-naphthylmethyl)carboxyamide]-2'-deoxyuridine
  misc_feature (30)..(30): n is 5-[N-(1-naphthylmethyl)carboxyamide]-2'-deoxyuridine
  misc_feature (32)..(32): n is 5-[N-(1-naphthylmethyl)carboxyamide]-2'-deoxyuridine
  misc_feature (34)..(34): n is 5-[N-(1-naphthylmethyl)carboxyamide]-2'-deoxyuridine
cgacagcangnangcacancnncnacacgnangnacgacagc

SEQ ID NO: 726 - DNA, 44 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (22)..(23): n is hexaethylene glycol
  misc_feature (24)..(24): n is 5-[N-(1-naphthylmethyl)carboxyamide]-2'-deoxyuridine
  misc_feature (26)..(26): n is 5-[N-(1-naphthylmethyl)carboxyamide]-2'-deoxyuridine
  misc_feature (32)..(32): n is 5-[N-(1-naphthylmethyl)carboxyamide]-2'-deoxyuridine
  misc_feature (34)..(34): n is 5-[N-(1-naphthylmethyl)carboxyamide]-2'-deoxyuridine
  misc_feature (36)..(36): n is 5-[N-(1-naphthylmethyl)carboxyamide]-2'-deoxyuridine
cgacagcangnangcacancnnnncnacacgnangnacgacagc

SEQ ID NO: 727 - DNA, 46 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (22)..(25): n is hexaethylene glycol
  misc_feature (26)..(26): n is 5-[N-(1-naphthylmethyl)carboxyamide]-2'-deoxyuridine
  misc_feature (28)..(28): n is 5-[N-(1-naphthylmethyl)carboxyamide]-2'-deoxyuridine
  misc_feature (34)..(34): n is 5-[N-(1-naphthylmethyl)carboxyamide]-2'-deoxyuridine
  misc_feature (36)..(36): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
cgacagcangnangcacancnnnnnncnacacgnangnacgacagc

SEQ ID NO: 728 - DNA, 48 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (22)..(27): n is hexaethylene glycol
  misc_feature (28)..(28): n is 5-[N-(1-naphthylmethyl)carboxyamide]-2'-deoxyuridine
  misc_feature (30)..(30): n is 5-[N-(1-naphthylmethyl)carboxyamide]-2'-deoxyuridine
  misc_feature (36)..(36): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (40)..(40): n is 5-[N-(1-naphthylmethyl)carboxyamide]-2'-deoxyuridine
cgacagcangnangcacancnnnnnnnncnacacgnangnacgacagc

SEQ ID NO: 729 - DNA, 58 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'- O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
  misc_feature (33)..(34): n is 5-[N-(1-naphthylmethyl)carboxyamide]-2'-deoxyuridine
  misc_feature (35)..(35): n is 2'-O-methyl-cytidine
  misc_feature (38)..(38): n is 2'-O-methyl-guanosine
  misc_feature (39)..(39): n is 5-[N-(1-naphthylmethyl)carboxyamide]-2'-deoxyuridine
  misc_feature (41)..(41): n is 2'-O-methyl-cytidine
  misc_feature (42)..(43): n is 5-[N-(1-naphthylmethyl)carboxyamide]-2'-deoxyuridine
  misc_feature (44)..(44): n is 2'-O-methyl-guanosine
  misc_feature (45)..(45): n is 5-[N-(1-naphthylmethyl)carboxyamide]-2'-deoxyuridine
  misc_feature (46)..(46): n is 2'-O-methyl-adenosine
  misc_feature (47)..(47): n is 2'-O-methyl-guanosine
  misc_feature (50)..(50): n is 5-[N-(1-naphthylmethyl)carboxyamide]-2'-deoxyuridine
  misc_feature (51)..(51): n is 5-[N-(1-naphthylmethyl)carboxyamide]-2'- O-methyl-uridine
  misc_feature (52)..(52): n is 5-[N-(1-naphthylmethyl)carboxyamide]-2'-deoxyuridine
  misc_feature (56)..(56): n is 5-[N-(1-naphthylmethyl)carboxyamide]-2'-deoxyuridine
  misc_feature (57)..(58): n is 2'-O-methyl-guanosine
ccgnnnaanngnnnnnnngannnaaannnccgnnnaanngnnnnnnngannnaaannn

SEQ ID NO: 730 - DNA, 59 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'- O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
  misc_feature (30)..(30): n is hexaethylene glycol
  misc_feature (34)..(35): n is 5-[N-(1-naphthylmethyl)carboxyamide]-2'-deoxyuridine
  misc_feature (36)..(36): n is 2'-O-methyl-cytidine
  misc_feature (39)..(39): n is 2'-O-methyl-guanosine
  misc_feature (40)..(40): n is 5-[N-(1-naphthylmethyl)carboxyamide]-2'-deoxyuridine
  misc_feature (42)..(42): n is 2'-O-methyl-cytidine
  misc_feature (43)..(44): n is 5-[N-(1-naphthylmethyl)carboxyamide]-2'-deoxyuridine
  misc_feature (45)..(45): n is 2'-O-methyl-guanosine
  misc_feature (46)..(46): n is 5-[N-(1-naphthylmethyl)carboxyamide]-2'-deoxyuridine
  misc_feature (47)..(47): n is 2'-O-methyl-adenosine
  misc_feature (48)..(48): n is 2'-O-methyl-guanosine
  misc_feature (51)..(51): n is 5-[N-(1-naphthylmethyl)carboxyamide]-2'-deoxyuridine
  misc_feature (52)..(52): n is 5-[N-(1-naphthylmethyl)carboxyamide]-2'- O-methyl-uridine
  misc_feature (53)..(53): n is 5-[N-(1-naphthylmethyl)carboxyamide]-2'-deoxyuridine
  misc_feature (57)..(57): n is 5-[N-(1-naphthylmethyl)carboxyamide]-2'-deoxyuridine
  misc_feature (58)..(59): n is 2'-O-methyl-guanosine
ccgnnnaanngnnnnnnngannnaaannnnccgnnnaanngnnnnnnngannnaaannn

SEQ ID NO: 731 - DNA, 60 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'- O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
  misc_feature (30)..(31): n is hexaethylene glycol
  misc_feature (35)..(36): n is 5-[N-(1-naphthylmethyl)carboxyamide]-2'-deoxyuridine
  misc_feature (37)..(37): n is 2'-O-methyl-cytidine
  misc_feature (40)..(40): n is 2'-O-methyl-guanosine
  misc_feature (41)..(41): n is 5-[N-(1-naphthylmethyl)carboxyamide]-2'-deoxyuridine
  misc_feature (43)..(43): n is 2'-O-methyl-cytidine
  misc_feature (44)..(45): n is 5-[N-(1-naphthylmethyl)carboxyamide]-2'-deoxyuridine
  misc_feature (46)..(46): n is 2'-O-methyl-guanosine
  misc_feature (47)..(47): n is 5-[N-(1-naphthylmethyl)carboxyamide]-2'-deoxyuridine
  misc_feature (48)..(48): n is 2'-O-methyl-adenosine
  misc_feature (49)..(49): n is 2'-O-methyl-guanosine
  misc_feature (52)..(52): n is 5-[N-(1-naphthylmethyl)carboxyamide]-2'-deoxyuridine
  misc_feature (53)..(53): n is 5-[N-(1-naphthylmethyl)carboxyamide]-2'- O-methyl-uridine
  misc_feature (54)..(54): n is 5-[N-(1-naphthylmethyl)carboxyamide]-2'-deoxyuridine
  misc_feature (58)..(58): n is 5-[N-(1-naphthylmethyl)carboxyamide]-2'-deoxyuridine
  misc_feature (59)..(60): n is 2'-O-methyl-guanosine
ccgnnnaanngnnnnnnngannnaaannnnnccgnnnaanngnnnnnnngannnaaannn

SEQ ID NO: 732 - DNA, 61 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'- O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
  misc_feature (30)..(32): n is hexaethylene glycol
  misc_feature (36)..(37): n is 5-[N-(1-naphthylmethyl)carboxyamide]-2'-deoxyuridine
  misc_feature (38)..(38): n is 2'-O-methyl-cytidine
  misc_feature (41)..(41): n is 2'-O-methyl-guanosine
  misc_feature (42)..(42): n is 5-[N-(1-naphthylmethyl)carboxyamide]-2'-deoxyuridine
  misc_feature (44)..(44): n is 2'-O-methyl-cytidine
  misc_feature (45)..(46): n is 5-[N-(1-naphthylmethyl)carboxyamide]-2'-deoxyuridine
  misc_feature (47)..(47): n is 2'-O-methyl-guanosine
  misc_feature (48)..(48): n is 5-[N-(1-naphthylmethyl)carboxyamide]-2'-deoxyuridine
  misc_feature (49)..(49): n is 2'-O-methyl-adenosine
  misc_feature (50)..(50): n is 2'-O-methyl-guanosine
  misc_feature (53)..(53): n is 5-[N-(1-naphthylmethyl)carboxyamide]-2'-deoxyuridine
  misc_feature (54)..(54): n is 5-[N-(1-naphthylmethyl)carboxyamide]-2'- O-methyl-uridine
  misc_feature (55)..(55): n is 5-[N-(1-naphthylmethyl)carboxyamide]-2'-deoxyuridine
  misc_feature (59)..(59): n is 5-[N-(1-naphthylmethyl)carboxyamide]-2'-deoxyuridine
  misc_feature (60)..(61): n is 2'-O-methyl-guanosine
ccgnnnaanngnnnnnnngannnaaannnnnnccgnnnaanngnnnnnnngannnaaannn

SEQ ID NO: 733 - DNA, 62 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'- O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
  misc_feature (30)..(33): n is hexaethylene glycol
  misc_feature (37)..(38): n is 5-[N-(1-naphthylmethyl)carboxyamide]-2'-deoxyuridine
  misc_feature (39)..(39): n is 2'-O-methyl-cytidine
  misc_feature (42)..(42): n is 2'-O-methyl-guanosine
  misc_feature (43)..(43): n is 5-[N-(1-naphthylmethyl)carboxyamide]-2'-deoxyuridine
  misc_feature (45)..(45): n is 2'-O-methyl-cytidine
  misc_feature (46)..(47): n is 5-[N-(1-naphthylmethyl)carboxyamide]-2'-deoxyuridine
  misc_feature (48)..(48): n is 2'-O-methyl-guanosine
  misc_feature (49)..(49): n is 5-[N-(1-naphthylmethyl)carboxyamide]-2'-deoxyuridine
  misc_feature (50)..(50): n is 2'-O-methyl-adenosine
  misc_feature (51)..(51): n is 2'-O-methyl-guanosine
  misc_feature (54)..(54): n is 5-[N-(1-naphthylmethyl)carboxyamide]-2'-deoxyuridine
  misc_feature (55)..(55): n is 5-[N-(1-naphthylmethyl)carboxyamide]-2'- O-methyl-uridine
  misc_feature (56)..(56): n is 5-[N-(1-naphthylmethyl)carboxyamide]-2'-deoxyuridine
  misc_feature (60)..(60): n is 5-[N-(1-naphthylmethyl)carboxyamide]-2'-deoxyuridine
  misc_feature (61)..(62): n is 2'-O-methyl-guanosine
ccgnnnaanngnnnnnnngannnaaannnnnnnccgnnnaanngnnnnnnngannnaaannn

SEQ ID NO: 734 - DNA, 63 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'- O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
  misc_feature (30)..(34): n is hexaethylene glycol
  misc_feature (38)..(39): n is 5-[N-(1-naphthylmethyl)carboxyamide]-2'-deoxyuridine
  misc_feature (40)..(40): n is 2'-O-methyl-cytidine
  misc_feature (43)..(43): n is 2'-O-methyl-guanosine
  misc_feature (44)..(44): n is 5-[N-(1-naphthylmethyl)carboxyamide]-2'-deoxyuridine
  misc_feature (46)..(46): n is 2'-O-methyl-cytidine
  misc_feature (47)..(48): n is 5-[N-(1-naphthylmethyl)carboxyamide]-2'-deoxyuridine
  misc_feature (49)..(49): n is 2'-O-methyl-guanosine
  misc_feature (50)..(50): n is 5-[N-(1-naphthylmethyl)carboxyamide]-2'-deoxyuridine
  misc_feature (51)..(51): n is 2'-O-methyl-adenosine
  misc_feature (52)..(52): n is 2'-O-methyl-guanosine
  misc_feature (55)..(55): n is 5-[N-(1-naphthylmethyl)carboxyamide]-2'-deoxyuridine
  misc_feature (56)..(56): n is 5-[N-(1-naphthylmethyl)carboxyamide]-2'- O-methyl-uridine
  misc_feature (57)..(57): n is 5-[N-(1-naphthylmethyl)carboxyamide]-2'-deoxyuridine
  misc_feature (61)..(61): n is 5-[N-(1-naphthylmethyl)carboxyamide]-2'-deoxyuridine
  misc_feature (62)..(63): n is 2'-O-methyl-guanosine
ccgnnnaanngnnnnnnngannnaaannnnnnnnccgnnnaanngnnnnnnngannnaaannn

SEQ ID NO: 735 - DNA, 64 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'- O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
  misc_feature (30)..(35): n is hexaethylene glycol
  misc_feature (39)..(40): n is 5-[N-(1-naphthylmethyl)carboxyamide]-2'-deoxyuridine
  misc_feature (41)..(41): n is 2'-O-methyl-cytidine
  misc_feature (44)..(44): n is 2'-O-methyl-guanosine
  misc_feature (45)..(45): n is 5-[N-(1-naphthylmethyl)carboxyamide]-2'-deoxyuridine
  misc_feature (47)..(47): n is 2'-O-methyl-cytidine
  misc_feature (48)..(49): n is 5-[N-(1-naphthylmethyl)carboxyamide]-2'-deoxyuridine
  misc_feature (50)..(50): n is 2'-O-methyl-guanosine
  misc_feature (51)..(51): n is 5-[N-(1-naphthylmethyl)carboxyamide]-2'-deoxyuridine
  misc_feature (52)..(52): n is 2'-O-methyl-adenosine
  misc_feature (53)..(53): n is 2'-O-methyl-guanosine
  misc_feature (56)..(56): n is 5-[N-(1-naphthylmethyl)carboxyamide]-2'-deoxyuridine
  misc_feature (57)..(57): n is 5-[N-(1-naphthylmethyl)carboxyamide]-2'- O-methyl-uridine
  misc_feature (58)..(58): n is 5-[N-(1-naphthylmethyl)carboxyamide]-2'-deoxyuridine
  misc_feature (62)..(62): n is 5-[N-(1-naphthylmethyl)carboxyamide]-2'-deoxyuridine
  misc_feature (63)..(64): n is 2'-O-methyl-guanosine
ccgnnnaanngnnnnnnngannnaaannnnnnnnnccgnnnaanngnnnnnnngannnaaannn

SEQ ID NO: 736 - DNA, 58 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'- O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(31): n is 2'-O-methyl-guanosine
  misc_feature (32)..(32): n is 5-[N-(1-naphthylmethyl)carboxyamide]-2'-deoxyuridine
  misc_feature (36)..(36): n is 5-[N-(1-naphthylmethyl)carboxyamide]-2'-deoxyuridine
  misc_feature (37)..(37): n is 5-[N-(1-naphthylmethyl)carboxyamide]-2'- O-methyl-uridine
  misc_feature (38)..(38): n is 5-[N-(1-naphthylmethyl)carboxyamide]-2'-deoxyuridine
  misc_feature (41)..(41): n is 2'-O-methyl-guanosine
  misc_feature (42)..(42): n is 2'-O-methyl-adenosine
  misc_feature (43)..(43): n is 5-[N-(1-naphthylmethyl)carboxyamide]-2'-deoxyuridine
  misc_feature (44)..(44): n is 2'-O-methyl-guanosine
  misc_feature (45)..(46): n is 5-[N-(1-naphthylmethyl)carboxyamide]-2'-deoxyuridine
  misc_feature (47)..(47): n is 2'-O-methyl-cytidine
  misc_feature (49)..(49): n is 5-[N-(1-naphthylmethyl)carboxyamide]-2'-deoxyuridine
  misc_feature (50)..(50): n is 2'-O-methyl-guanosine
  misc_feature (53)..(53): n is 2'-O-methyl-cytidine
  misc_feature (54)..(55): n is 5-[N-(1-naphthylmethyl)carboxyamide]-2'-deoxyuridine
ccgnnnaanngnnnnnnngannnaaannnnnnaaannnagnnnnnnngnnaannngcc

SEQ ID NO: 737 - DNA, 60 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'- O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
  misc_feature (30)..(31): n is hexaethylene glycol
  misc_feature (32)..(33): n is 2'-O-methyl-guanosine
  misc_feature (34)..(34): n is 5-[N-(1-naphthylmethyl)carboxyamide]-2'-deoxyuridine
  misc_feature (38)..(38): n is 5-[N-(1-naphthylmethyl)carboxyamide]-2'-deoxyuridine
  misc_feature (39)..(39): n is 5-[N-(1-naphthylmethyl)carboxyamide]-2'- O-methyl-uridine
  misc_feature (40)..(40): n is 5-[N-(1-naphthylmethyl)carboxyamide]-2'-deoxyuridine
  misc_feature (43)..(43): n is 2'-O-methyl-guanosine
  misc_feature (44)..(44): n is 2'-O-methyl-adenosine
  misc_feature (45)..(45): n is 5-[N-(1-naphthylmethyl)carboxyamide]-2'-deoxyuridine
  misc_feature (46)..(46): n is 2'-O-methyl-guanosine
  misc_feature (47)..(48): n is 5-[N-(1-naphthylmethyl)carboxyamide]-2'-deoxyuridine
  misc_feature (49)..(49): n is 2'-O-methyl-cytidine
  misc_feature (51)..(51): n is 5-[N-(1-naphthylmethyl)carboxyamide]-2'-deoxyuridine
  misc_feature (52)..(52): n is 2'-O-methyl-guanosine
  misc_feature (55)..(55): n is 2'-O-methyl-cytidine
  misc_feature (56)..(57): n is 5-[N-(1-naphthylmethyl)carboxyamide]-2'-deoxyuridine
ccgnnnaanngnnnnnnngannnaaannnnnnnnaaannnagnnnnnnngnnaannngcc

SEQ ID NO: 738 - DNA, 62 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'- O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
  misc_feature (30)..(33): n is hexaethylene glycol
  misc_feature (34)..(35): n is 2'-O-methyl-guanosine
  misc_feature (36)..(36): n is 5-[N-(1-naphthylmethyl)carboxyamide]-2'-deoxyuridine
  misc_feature (40)..(40): n is 5-[N-(1-naphthylmethyl)carboxyamide]-2'-deoxyuridine
  misc_feature (41)..(41): n is 5-[N-(1-naphthylmethyl)carboxyamide]-2'- O-methyl-uridine
  misc_feature (42)..(42): n is 5-[N-(1-naphthylmethyl)carboxyamide]-2'-deoxyuridine
  misc_feature (45)..(45): n is 2'-O-methyl-guanosine
  misc_feature (46)..(46): n is 2'-O-methyl-adenosine
  misc_feature (47)..(47): n is 5-[N-(1-naphthylmethyl)carboxyamide]-2'-deoxyuridine
  misc_feature (48)..(48): n is 2'-O-methyl-guanosine
  misc_feature (49)..(50): n is 5-[N-(1-naphthylmethyl)carboxyamide]-2'-deoxyuridine
  misc_feature (51)..(51): n is 2'-O-methyl-cytidine
  misc_feature (53)..(53): n is 5-[N-(1-naphthylmethyl)carboxyamide]-2'-deoxyuridine
  misc_feature (54)..(54): n is 2'-O-methyl-guanosine
  misc_feature (57)..(57): n is 2'-O-methyl-cytidine
  misc_feature (58)..(59): n is 5-[N-(1-naphthylmethyl)carboxyamide]-2'-deoxyuridine
ccgnnnaanngnnnnnnngannnaaannnnnnnnnnaaannnagnnnnnnngnnaannngcc

SEQ ID NO: 739 - DNA, 64 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'- O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
  misc_feature (30)..(35): n is hexaethylene glycol
  misc_feature (36)..(37): n is 2'-O-methyl-guanosine
  misc_feature (38)..(38): n is 5-[N-(1-naphthylmethyl)carboxyamide]-2'-deoxyuridine
  misc_feature (42)..(42): n is 5-[N-(1-naphthylmethyl)carboxyamide]-2'-deoxyuridine
  misc_feature (43)..(43): n is 5-[N-(1-naphthylmethyl)carboxyamide]-2'- O-methyl-uridine
  misc_feature (44)..(44): n is 5-[N-(1-naphthylmethyl)carboxyamide]-2'-deoxyuridine
  misc_feature (47)..(47): n is 2'-O-methyl-guanosine
  misc_feature (48)..(48): n is 2'-O-methyl-adenosine
  misc_feature (49)..(49): n is 5-[N-(1-naphthylmethyl)carboxyamide]-2'-deoxyuridine
  misc_feature (50)..(50): n is 2'-O-methyl-guanosine
  misc_feature (51)..(52): n is 5-[N-(1-naphthylmethyl)carboxyamide]-2'-deoxyuridine
  misc_feature (53)..(53): n is 2'-O-methyl-cytidine
  misc_feature (55)..(55): n is 5-[N-(1-naphthylmethyl)carboxyamide]-2'-deoxyuridine
  misc_feature (56)..(56): n is 2'-O-methyl-guanosine
  misc_feature (59)..(59): n is 2'-O-methyl-cytidine
  misc_feature (60)..(61): n is 5-[N-(1-naphthylmethyl)carboxyamide]-2'-deoxyuridine
ccgnnnaanngnnnnnnngannnaaannnnnnnnnnnnaaannnagnnnnnnngnnaannngcc

SEQ ID NO: 740 - DNA, 52 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (15)..(15): n is 1,3-propane diol
  misc_feature (16)..(16): n is 5-[N-(1-naphthylmethyl)carboxyamide]-2'-deoxyuridine
  misc_feature (18)..(18): n is 1,3-propane diol
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (30)..(31): n is 5-(N-benzylcarboxyamide)-2'-deoxyuridine
  misc_feature (32)..(32): n is 2'-O-methyl-adenosine
  misc_feature (34)..(34): n is hexaethylene glycol
  misc_feature (36)..(37): n is 5-(N-benzylcarboxyamide)-2'-deoxyuridine
  misc_feature (40)..(40): n is 2'-O-methyl-adenosine
  misc_feature (41)..(41): n is 2'-O-methyl-cytidine
  misc_feature (45)..(47): n is 5-(N-benzylcarboxyamide)-2'-deoxyuridine
  misc_feature (48)..(48): n is 2'-O-methyl-adenosine
  misc_feature (49)..(49): n is 5-(N-benzylcarboxyamide)-2'-deoxyuridine
  misc_feature (50)..(50): n is 2'-O-methyl-adenosine
ccgnncaagngcnnnnangannnaaanggnnncngnnacnngcgnnnnnngc

SEQ ID NO: 741 - DNA, 53 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (15)..(15): n is 1,3-propane diol
  misc_feature (16)..(16): n is 5-[N-(1-naphthylmethyl)carboxyamide]-2'-deoxyuridine
  misc_feature (18)..(18): n is 1,3-propane diol
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (30)..(30): n is hexaethylene glycol
  misc_feature (31)..(32): n is 5-(N-benzylcarboxyamide)-2'-deoxyuridine
  misc_feature (33)..(33): n is 2'-O-methyl-adenosine
  misc_feature (35)..(35): n is hexaethylene glycol
  misc_feature (37)..(38): n is 5-(N-benzylcarboxyamide)-2'-deoxyuridine
  misc_feature (41)..(41): n is 2'-O-methyl-adenosine
  misc_feature (42)..(42): n is 2'-O-methyl-cytidine
  misc_feature (46)..(48): n is 5-(N-benzylcarboxyamide)-2'-deoxyuridine
  misc_feature (49)..(49): n is 2'-O-methyl-adenosine
  misc_feature (50)..(50): n is 5-(N-benzylcarboxyamide)-2'-deoxyuridine
  misc_feature (51)..(51): n is 2'-O-methyl-adenosine
ccgnncaagngcnnnnangannnaaanggnnnncngnnacnngcgnnnnnngc

SEQ ID NO: 742 - DNA, 54 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (15)..(15): n is 1,3-propane diol
  misc_feature (16)..(16): n is 5-[N-(1-naphthylmethyl)carboxyamide]-2'-deoxyuridine
  misc_feature (18)..(18): n is 1,3-propane diol
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (30)..(31): n is hexaethylene glycol
  misc_feature (32)..(33): n is 5-(N-benzylcarboxyamide)-2'-deoxyuridine
  misc_feature (34)..(34): n is 2'-O-methyl-adenosine
  misc_feature (36)..(36): n is hexaethylene glycol
  misc_feature (38)..(39): n is 5-(N-benzylcarboxyamide)-2'-deoxyuridine
  misc_feature (42)..(42): n is 2'-O-methyl-adenosine
  misc_feature (43)..(43): n is 2'-O-methyl-cytidine
  misc_feature (47)..(49): n is 5-(N-benzylcarboxyamide)-2'-deoxyuridine
  misc_feature (50)..(50): n is 2'-O-methyl-adenosine
  misc_feature (51)..(51): n is 5-(N-benzylcarboxyamide)-2'-deoxyuridine
  misc_feature (52)..(52): n is 2'-O-methyl-adenosine
ccgnncaagngcnnnnangannnaaanggnnnnncngnnacnngcgnnnnnngc

SEQ ID NO: 743 - DNA, 55 bp, Artificial Sequence
  Synthetic
  misc_feature (4)..(5): n is 5-[N-(1-naphthylmethyl)carboxyamide]-2'-deoxyuridine
  misc_feature (10)..(10): n is 5-[N-(1-naphthylmethyl)carboxyamide]-2'-deoxyuridine
  misc_feature (13)..(14): n is 5-[N-(1-naphthylmethyl)carboxyamide]-2'-deoxyuridine
  misc_feature (15)..(15): n is 1,3-propane diol
  misc_feature (16)..(16): n is 5-[N-(1-naphthylmethyl)carboxyamide]-2'-deoxyuridine
  misc_feature (18)..(18): n is 1,3-propane diol
  misc_feature (21)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (30)..(32): n is hexaethylene glycol
  misc_feature (33)..(34): n is 5-(N-benzylcarboxyamide)-2'-deoxyuridine
  misc_feature (35)..(35): n is 2'-O-methyl-adenosine
  misc_feature (37)..(37): n is hexaethylene glycol
  misc_feature (39)..(40): n is 5-(N-benzylcarboxyamide)-2'-deoxyuridine
  misc_feature (43)..(43): n is 2'-O-methyl-adenosine
  misc_feature (44)..(44): n is 2'-O-methyl-cytidine
  misc_feature (48)..(50): n is 5-(N-benzylcarboxyamide)-2'-deoxyuridine
  misc_feature (51)..(51): n is 2'-O-methyl-adenosine
  misc_feature (52)..(52): n is 5-(N-benzylcarboxyamide)-2'-deoxyuridine
  misc_feature (53)..(53): n is 2'-O-methyl-adenosine
ccgnncaagngcnnnnangannnaaanggnnnnnncngnnacnngcgnnnnnngc

SEQ ID NO: 744 - DNA, 52 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(18): n is 5-(N-benzylcarboxyamide)-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (28)..(29): n is 5-[N-(1-naphthylmethyl)carboxyamide]-2'-deoxyuridine
  misc_feature (34)..(34): n is 5-[N-(1-naphthylmethyl)carboxyamide]-2'-deoxyuridine
  misc_feature (37)..(38): n is 5-[N-(1-naphthylmethyl)carboxyamide]-2'-deoxyuridine
  misc_feature (39)..(39): n is 1,3-propane diol
  misc_feature (40)..(40): n is 5-[N-(1-naphthylmethyl)carboxyamide]-2'-deoxyuridine
  misc_feature (42)..(42): n is 1,3-propane diol
  misc_feature (45)..(47): n is 5-[N-(1-naphthylmethyl)carboxyamide]-2'-deoxyuridine
  misc_feature (51)..(51): n is 5-[N-(1-naphthylmethyl)carboxyamide]-2'-deoxyuridine
nnncngnnacnngcgnnnnnngcnccgnncaagngcnnnnangannnaaang

SEQ ID NO: 745 - DNA, 53 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(18): n is 5-(N-benzylcarboxyamide)-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(25): n is hexaethylene glycol
  misc_feature (29)..(30): n is 5-[N-(1-naphthylmethyl)carboxyamide]-2'-deoxyuridine
  misc_feature (35)..(35): n is 5-[N-(1-naphthylmethyl)carboxyamide]-2'-deoxyuridine
  misc_feature (38)..(39): n is 5-[N-(1-naphthylmethyl)carboxyamide]-2'-deoxyuridine
  misc_feature (40)..(40): n is 1,3-propane diol
  misc_feature (41)..(41): n is 5-[N-(1-naphthylmethyl)carboxyamide]-2'-deoxyuridine
  misc_feature (43)..(43): n is 1,3-propane diol
  misc_feature (46)..(48): n is 5-[N-(1-naphthylmethyl)carboxyamide]-2'-deoxyuridine
  misc_feature (52)..(52): n is 5-[N-(1-naphthylmethyl)carboxyamide]-2'-deoxyuridine
nnncngnnacnngcgnnnnnngcnnccgnncaagngcnnnnangannnaaang

SEQ ID NO: 746 - DNA, 54 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(18): n is 5-(N-benzylcarboxyamide)-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(26): n is hexaethylene glycol
  misc_feature (30)..(31): n is 5-[N-(1-naphthylmethyl)carboxyamide]-2'-deoxyuridine
  misc_feature (36)..(36): n is 5-[N-(1-naphthylmethyl)carboxyamide]-2'-deoxyuridine
  misc_feature (39)..(40): n is 5-[N-(1-naphthylmethyl)carboxyamide]-2'-deoxyuridine
  misc_feature (41)..(41): n is 1,3-propane diol
  misc_feature (42)..(42): n is 5-[N-(1-naphthylmethyl)carboxyamide]-2'-deoxyuridine
  misc_feature (44)..(44): n is 1,3-propane diol
  misc_feature (47)..(49): n is 5-[N-(1-naphthylmethyl)carboxyamide]-2'-deoxyuridine
  misc_feature (53)..(53): n is 5-[N-(1-naphthylmethyl)carboxyamide]-2'-deoxyuridine
nnncngnnacnngcgnnnnnngcnnnccgnncaagngcnnnnangannnaaang

SEQ ID NO: 747 - DNA, 55 bp, Artificial Sequence
  Synthetic
  misc_feature (1)..(2): n is 5-(N-benzylcarboxyamide)-2'-deoxyuridine
  misc_feature (3)..(3): n is 2'-O-methyl-adenosine
  misc_feature (5)..(5): n is hexaethylene glycol
  misc_feature (7)..(8): n is 5-(N-benzylcarboxyamide)-2'-deoxyuridine
  misc_feature (11)..(11): n is 2'-O-methyl-adenosine
  misc_feature (12)..(12): n is 2'-O-methyl-cytidine
  misc_feature (16)..(18): n is 5-(N-benzylcarboxyamide)-2'-deoxyuridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(27): n is hexaethylene glycol
  misc_feature (31)..(32): n is 5-[N-(1-naphthylmethyl)carboxyamide]-2'-deoxyuridine
  misc_feature (37)..(37): n is 5-[N-(1-naphthylmethyl)carboxyamide]-2'-deoxyuridine
  misc_feature (40)..(41): n is 5-[N-(1-naphthylmethyl)carboxyamide]-2'-deoxyuridine
  misc_feature (42)..(42): n is 1,3-propane diol
  misc_feature (43)..(43): n is 5-[N-(1-naphthylmethyl)carboxyamide]-2'-deoxyuridine
  misc_feature (45)..(45): n is 1,3-propane diol
  misc_feature (48)..(50): n is 5-[N-(1-naphthylmethyl)carboxyamide]-2'-deoxyuridine
  misc_feature (54)..(54): n is 5-[N-(1-naphthylmethyl)carboxyamide]-2'-deoxyuridine
nnncngnnacnngcgnnnnnngcnnnnccgnncaagngcnnnnangannnaaang

SEQ ID NO: 748 - DNA, 56 bp, Artificial Sequence
  Synthetic
  misc_feature (1)..(1): n is 5-(N-benzylcarboxyamide)-2'-deoxyuridine
  misc_feature (2)..(2): n is 5-[N-(3,4-methylenedioxyphenyl-methyl)carboxyamide]-2'-deoxyuridi ne
  misc_feature (3)..(3): n is 2'-O-methyl-adenosine
  misc_feature (5)..(5): n is hexaethylene glycol
  misc_feature (7)..(7): n is 5-(N-benzylcarboxyamide)-2'-O-methyl-uridine
  misc_feature (8)..(8): n is 5-(N-benzylcarboxyamide)-2'-deoxyuridine
  misc_feature (11)..(11): n is 1,3-propane diol
  misc_feature (12)..(12): n is 2'-O-methyl-cytidine
  misc_feature (16)..(17): n is 5-(N-benzylcarboxyamide)-2'-deoxyuridine
  misc_feature (18)..(18): n is 5-(N-benzylcarboxyamide)-2'-O-methyl-uridine
  misc_feature (19)..(19): n is 2'-O-methyl-adenosine
  misc_feature (20)..(20): n is 5-(N-benzylcarboxyamide)-2'-deoxyuridine
  misc_feature (21)..(21): n is 2'-O-methyl-adenosine
  misc_feature (24)..(24): n is 2'-O-methyl-guanosine
  misc_feature (25)..(27): n is hexaethylene glycol
  misc_feature (31)..(32): n is 5-[N-(1-naphthylmethyl)carboxyamide]-2'-deoxyuridine
  misc_feature (33)..(33): n is 2'-O-methyl-cytidine
  misc_feature (36)..(36): n is 2'-O-methyl-guanosine
  misc_feature (37)..(37): n is 5-[N-(1-naphthylmethyl)carboxyamide]-2'-deoxyuridine
  misc_feature (39)..(39): n is 2'-O-methyl-cytidine
  misc_feature (40)..(41): n is 5-[N-(1-naphthylmethyl)carboxyamide]-2'-deoxyuridine
  misc_feature (42)..(42): n is 2'-O-methyl-guanosine
  misc_feature (43)..(43): n is 5-[N-(1-naphthylmethyl)carboxyamide]-2'-deoxyuridine
  misc_feature (44)..(44): n is 2'-O-methyl-adenosine
  misc_feature (45)..(45): n is 2'-O-methyl-guanosine
  misc_feature (48)..(48): n is 5-[N-(1-naphthylmethyl)carboxyamide]-2'-deoxyuridine
  misc_feature (49)..(49): n is 5-[N-(1-naphthylmethyl)carboxyamide]-2'- O-methyl-uridine
  misc_feature (50)..(50): n is 5-[N-(1-naphthylmethyl)carboxyamide]-2'-deoxyuridine
  misc_feature (54)..(54): n is 5-[N-(1-naphthylmethyl)carboxyamide]-2'-deoxyuridine
  misc_feature (55)..(56): n is 2'-O-methyl-guanosine
nnncngnnacnngcgnnnnnngcnnnnccgnnnaanngnnnnnnngannnaaannn

SEQ ID NO: 749 - DNA, 56 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'- O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
  misc_feature (30)..(35): n is hexaethylene glycol
  misc_feature (44)..(44): n is 5-[N-(1-naphthylmethyl)carboxyamide]-2'-deoxyuridine
  misc_feature (46)..(46): n is 5-[N-(1-naphthylmethyl)carboxyamide]-2'-deoxyuridine
  misc_feature (48)..(48): n is 5-[N-(1-naphthylmethyl)carboxyamide]-2'-deoxyuridine
  misc_feature (54)..(54): n is 5-[N-(1-naphthylmethyl)carboxyamide]-2'-deoxyuridine
  misc_feature (56)..(56): n is 5-[N-(1-naphthylmethyl)carboxyamide]-2'-deoxyuridine
ccgnnnaanngnnnnnnngannnaaannnnnnnnncgacagcangnangcacancn

SEQ ID NO: 750 - DNA, 55 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'- O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
  misc_feature (30)..(34): n is hexaethylene glycol
  misc_feature (43)..(43): n is 5-[N-(1-naphthylmethyl)carboxyamide]-2'-deoxyuridine
  misc_feature (45)..(45): n is 5-[N-(1-naphthylmethyl)carboxyamide]-2'-deoxyuridine
  misc_feature (47)..(47): n is 5-[N-(1-naphthylmethyl)carboxyamide]-2'-deoxyuridine
  misc_feature (53)..(53): n is 5-[N-(1-naphthylmethyl)carboxyamide]-2'-deoxyuridine
  misc_feature (55)..(55): n is 5-[N-(1-naphthylmethyl)carboxyamide]-2'-deoxyuridine
ccgnnnaanngnnnnnnngannnaaannnnnnnncgacagcangnangcacancn

SEQ ID NO: 751 - DNA, 54 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'- O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
  misc_feature (30)..(33): n is hexaethylene glycol
  misc_feature (42)..(42): n is 5-[N-(1-naphthylmethyl)carboxyamide]-2'-deoxyuridine
  misc_feature (44)..(44): n is 5-[N-(1-naphthylmethyl)carboxyamide]-2'-deoxyuridine
  misc_feature (46)..(46): n is 5-[N-(1-naphthylmethyl)carboxyamide]-2'-deoxyuridine
  misc_feature (52)..(52): n is 5-[N-(1-naphthylmethyl)carboxyamide]-2'-deoxyuridine
  misc_feature (54)..(54): n is 5-[N-(1-naphthylmethyl)carboxyamide]-2'-deoxyuridine
ccgnnnaanngnnnnnnngannnaaannnnnnncgacagcangnangcacancn

SEQ ID NO: 752 - DNA, 53 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'- O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
  misc_feature (30)..(32): n is hexaethylene glycol
  misc_feature (41)..(41): n is 5-[N-(1-naphthylmethyl)carboxyamide]-2'-deoxyuridine
  misc_feature (43)..(43): n is 5-[N-(1-naphthylmethyl)carboxyamide]-2'-deoxyuridine
  misc_feature (45)..(45): n is 5-[N-(1-naphthylmethyl)carboxyamide]-2'-deoxyuridine
  misc_feature (51)..(51): n is 5-[N-(1-naphthylmethyl)carboxyamide]-2'-deoxyuridine
  misc_feature (53)..(53): n is 5-[N-(1-naphthylmethyl)carboxyamide]-2'-deoxyuridine
ccgnnnaanngnnnnnnngannnaaannnnnncgacagcangnangcacancn

SEQ ID NO: 753 - DNA, 52 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'- O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
  misc_feature (30)..(31): n is hexaethylene glycol
  misc_feature (40)..(40): n is 5-[N-(1-naphthylmethyl)carboxyamide]-2'-deoxyuridine
  misc_feature (42)..(42): n is 5-[N-(1-naphthylmethyl)carboxyamide]-2'-deoxyuridine
  misc_feature (44)..(44): n is 5-[N-(1-naphthylmethyl)carboxyamide]-2'-deoxyuridine
  misc_feature (50)..(50): n is 5-[N-(1-naphthylmethyl)carboxyamide]-2'-deoxyuridine
  misc_feature (52)..(52): n is 5-[N-(1-naphthylmethyl)carboxyamide]-2'-deoxyuridine
ccgnnnaanngnnnnnnngannnaaannnnncgacagcangnangcacancn

SEQ ID NO: 754 - DNA, 51 bp, Artificial Sequence
  Synthetic
  misc_feature (4)..(5): n is 5-[N-(1-naphthylmethyl)carboxyamide]-2'-deoxyuridine
  misc_feature (6)..(6): n is 2'-O-methyl-cytidine
  misc_feature (9)..(9): n is 2'-O-methyl-guanosine
  misc_feature (10)..(10): n is 5-[N-(1-naphthylmethyl)carboxyamide]-2'-deoxyuridine
  misc_feature (12)..(12): n is 2'-O-methyl-cytidine
  misc_feature (13)..(14): n is 5-[N-(1-naphthylmethyl)carboxyamide]-2'-deoxyuridine
  misc_feature (15)..(15): n is 2'-O-methyl-guanosine
  misc_feature (16)..(16): n is 5-[N-(1-naphthylmethyl)carboxyamide]-2'-deoxyuridine
  misc_feature (17)..(17): n is 2'-O-methyl-adenosine
  misc_feature (18)..(18): n is 2'-O-methyl-guanosine
  misc_feature (21)..(21): n is 5-[N-(1-naphthylmethyl)carboxyamide]-2'-deoxyuridine
  misc_feature (22)..(22): n is 5-[N-(1-naphthylmethyl)carboxyamide]-2'- O-methyl-uridine
  misc_feature (23)..(23): n is 5-[N-(1-naphthylmethyl)carboxyamide]-2'-deoxyuridine
  misc_feature (27)..(27): n is 5-[N-(1-naphthylmethyl)carboxyamide]-2'-deoxyuridine
  misc_feature (28)..(29): n is 2'-O-methyl-guanosine
  misc_feature (30)..(30): n is hexaethylene glycol
  misc_feature (39)..(39): n is 5-[N-(1-naphthylmethyl)carboxyamide]-2'-deoxyuridine
  misc_feature (41)..(41): n is 5-[N-(1-naphthylmethyl)carboxyamide]-2'-deoxyuridine
  misc_feature (43)..(43): n is 5-[N-(1-naphthylmethyl)carboxyamide]-2'-deoxyuridine
  misc_feature (49)..(49): n is 5-[N-(1-naphthylmethyl)carboxyamide]-2'-deoxyuridine
  misc_feature (51)..(51): n is 5-[N-(1-naphthylmethyl)carboxyamide]-2'-deoxyuridine
ccgnnnaanngnnnnnnngannnaaannnncgacagcangnangcacancn

SEQ ID NO: 755 - DNA, 56 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (22)..(27): n is hexaethylene glycol
  misc_feature (31)..(32): n is 5-[N-(1-naphthylmethyl)carboxyamide]-2'-deoxyuridine
  misc_feature (33)..(33): n is 2'-O-methyl-cytidine
  misc_feature (36)..(36): n is 2'-O-methyl-guanosine
  misc_feature (37)..(37): n is 5-[N-(1-naphthylmethyl)carboxyamide]-2'-deoxyuridine
  misc_feature (39)..(39): n is 2'-O-methyl-cytidine
  misc_feature (40)..(41): n is 5-[N-(1-naphthylmethyl)carboxyamide]-2'-deoxyuridine
  misc_feature (42)..(42): n is 2'-O-methyl-guanosine
  misc_feature (43)..(43): n is 5-[N-(1-naphthylmethyl)carboxyamide]-2'-deoxyuridine
  misc_feature (44)..(44): n is 2'-O-methyl-adenosine
  misc_feature (45)..(45): n is 2'-O-methyl-guanosine
  misc_feature (48)..(48): n is 5-[N-(1-naphthylmethyl)carboxyamide]-2'-deoxyuridine
  misc_feature (49)..(49): n is 5-[N-(1-naphthylmethyl)carboxyamide]-2'- O-methyl-uridine
  misc_feature (50)..(50): n is 5-[N-(1-naphthylmethyl)carboxyamide]-2'-deoxyuridine
  misc_feature (54)..(54): n is 5-[N-(1-naphthylmethyl)carboxyamide]-2'-deoxyuridine
  misc_feature (55)..(56): n is 2'-O-methyl-guanosine
cgacagcangnangcacancnnnnnnnccgnnnaanngnnnnnnngannnaaannn

SEQ ID NO: 756 - DNA, 55 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (22)..(26): n is hexaethylene glycol
  misc_feature (30)..(31): n is 5-[N-(1-naphthylmethyl)carboxyamide]-2'-deoxyuridine
  misc_feature (32)..(32): n is 2'-O-methyl-cytidine
  misc_feature (35)..(35): n is 2'-O-methyl-guanosine
  misc_feature (36)..(36): n is 5-[N-(1-naphthylmethyl)carboxyamide]-2'-deoxyuridine
  misc_feature (38)..(38): n is 2'-O-methyl-cytidine
  misc_feature (39)..(40): n is 5-[N-(1-naphthylmethyl)carboxyamide]-2'-deoxyuridine
  misc_feature (41)..(41): n is 2'-O-methyl-guanosine
  misc_feature (42)..(42): n is 5-[N-(1-naphthylmethyl)carboxyamide]-2'-deoxyuridine
  misc_feature (43)..(43): n is 2'-O-methyl-adenosine
  misc_feature (44)..(44): n is 2'-O-methyl-guanosine
  misc_feature (47)..(47): n is 5-[N-(1-naphthylmethyl)carboxyamide]-2'-deoxyuridine
  misc_feature (48)..(48): n is 5-[N-(1-naphthylmethyl)carboxyamide]-2'- O-methyl-uridine
  misc_feature (49)..(49): n is 5-[N-(1-naphthylmethyl)carboxyamide]-2'-deoxyuridine
  misc_feature (53)..(53): n is 5-[N-(1-naphthylmethyl)carboxyamide]-2'-deoxyuridine
  misc_feature (54)..(55): n is 2'-O-methyl-guanosine
cgacagcangnangcacancnnnnnnccgnnnaanngnnnnnnngannnaaannn

SEQ ID NO: 757 - DNA, 54 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (22)..(25): n is hexaethylene glycol
  misc_feature (29)..(30): n is 5-[N-(1-naphthylmethyl)carboxyamide]-2'-deoxyuridine
  misc_feature (31)..(31): n is 2'-O-methyl-cytidine
  misc_feature (34)..(34): n is 2'-O-methyl-guanosine
  misc_feature (35)..(35): n is 5-[N-(1-naphthylmethyl)carboxyamide]-2'-deoxyuridine
  misc_feature (37)..(37): n is 2'-O-methyl-cytidine
  misc_feature (38)..(39): n is 5-[N-(1-naphthylmethyl)carboxyamide]-2'-deoxyuridine
  misc_feature (40)..(40): n is 2'-O-methyl-guanosine
  misc_feature (41)..(41): n is 5-[N-(1-naphthylmethyl)carboxyamide]-2'-deoxyuridine
  misc_feature (42)..(42): n is 2'-O-methyl-adenosine
  misc_feature (43)..(43): n is 2'-O-methyl-guanosine
  misc_feature (46)..(46): n is 5-[N-(1-naphthylmethyl)carboxyamide]-2'-deoxyuridine
  misc_feature (47)..(47): n is 5-[N-(1-naphthylmethyl)carboxyamide]-2'- O-methyl-uridine
  misc_feature (48)..(48): n is 5-[N-(1-naphthylmethyl)carboxyamide]-2'-deoxyuridine
  misc_feature (52)..(52): n is 5-[N-(1-naphthylmethyl)carboxyamide]-2'-deoxyuridine
  misc_feature (53)..(54): n is 2'-O-methyl-guanosine
cgacagcangnangcacancnnnnnccgnnnaanngnnnnnnngannnaaannn

SEQ ID NO: 758 - DNA, 53 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (22)..(24): n is hexaethylene glycol
  misc_feature (28)..(29): n is 5-[N-(1-naphthylmethyl)carboxyamide]-2'-deoxyuridine
  misc_feature (30)..(30): n is 2'-O-methyl-cytidine
  misc_feature (33)..(33): n is 2'-O-methyl-guanosine
  misc_feature (34)..(34): n is 5-[N-(1-naphthylmethyl)carboxyamide]-2'-deoxyuridine
  misc_feature (36)..(36): n is 2'-O-methyl-cytidine
  misc_feature (37)..(38): n is 5-[N-(1-naphthylmethyl)carboxyamide]-2'-deoxyuridine
  misc_feature (39)..(39): n is 2'-O-methyl-guanosine
  misc_feature (40)..(40): n is 5-[N-(1-naphthylmethyl)carboxyamide]-2'-deoxyuridine
  misc_feature (41)..(41): n is 2'-O-methyl-adenosine
  misc_feature (42)..(42): n is 2'-O-methyl-guanosine
  misc_feature (45)..(45): n is 5-[N-(1-naphthylmethyl)carboxyamide]-2'-deoxyuridine
  misc_feature (46)..(46): n is 5-[N-(1-naphthylmethyl)carboxyamide]-2'- O-methyl-uridine
  misc_feature (47)..(47): n is 5-[N-(1-naphthylmethyl)carboxyamide]-2'-deoxyuridine
  misc_feature (51)..(51): n is 5-[N-(1-naphthylmethyl)carboxyamide]-2'-deoxyuridine
  misc_feature (52)..(53): n is 2'-O-methyl-guanosine
cgacagcangnangcacancnnnnccgnnnaanngnnnnnnngannnaaannn

SEQ ID NO: 759 - DNA, 52 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (22)..(23): n is hexaethylene glycol
  misc_feature (27)..(28): n is 5-[N-(1-naphthylmethyl)carboxyamide]-2'-deoxyuridine
  misc_feature (29)..(29): n is 2'-O-methyl-cytidine
  misc_feature (32)..(32): n is 2'-O-methyl-guanosine
  misc_feature (33)..(33): n is 5-[N-(1-naphthylmethyl)carboxyamide]-2'-deoxyuridine
  misc_feature (35)..(35): n is 2'-O-methyl-cytidine
  misc_feature (36)..(37): n is 5-[N-(1-naphthylmethyl)carboxyamide]-2'-deoxyuridine
  misc_feature (38)..(38): n is 2'-O-methyl-guanosine
  misc_feature (39)..(39): n is 5-[N-(1-naphthylmethyl)carboxyamide]-2'-deoxyuridine
  misc_feature (40)..(40): n is 2'-O-methyl-adenosine
  misc_feature (41)..(41): n is 2'-O-methyl-guanosine
  misc_feature (44)..(44): n is 5-[N-(1-naphthylmethyl)carboxyamide]-2'-deoxyuridine
  misc_feature (45)..(45): n is 5-[N-(1-naphthylmethyl)carboxyamide]-2'- O-methyl-uridine
  misc_feature (46)..(46): n is 5-[N-(1-naphthylmethyl)carboxyamide]-2'-deoxyuridine
  misc_feature (50)..(50): n is 5-[N-(1-naphthylmethyl)carboxyamide]-2'-deoxyuridine
  misc_feature (51)..(52): n is 2'-O-methyl-guanosine
cgacagcangnangcacancnnnccgnnnaanngnnnnnnngannnaaannn

SEQ ID NO: 760 - DNA, 51 bp, Artificial Sequence
  Synthetic
  misc_feature (9)..(9): n is 5-[N-(1-naphthylmethyl)carboxyamide]-2'-deoxyuridine
  misc_feature (11)..(11): n is 5-[N-(1-naphthylmethyl)carboxyamide]-2'-deoxyuridine
  misc_feature (13)..(13): n is 5-[N-(1-naphthylmethyl)carboxyamide]-2'-deoxyuridine
  misc_feature (19)..(19): n is 5-[N-(1-naphthylmethyl)carboxyamide]-2'-deoxyuridine
  misc_feature (21)..(21): n is 5-[N-(1-naphthylmethyl)carboxyamide]-2'-deoxyuridine
  misc_feature (22)..(22): n is hexaethylene glycol
  misc_feature (26)..(27): n is 5-[N-(1-naphthylmethyl)carboxyamide]-2'-deoxyuridine
  misc_feature (28)..(28): n is 2'-O-methyl-cytidine
  misc_feature (31)..(31): n is 2'-O-methyl-guanosine
  misc_feature (32)..(32): n is 5-[N-(1-naphthylmethyl)carboxyamide]-2'-deoxyuridine
  misc_feature (34)..(34): n is 2'-O-methyl-cytidine
  misc_feature (35)..(36): n is 5-[N-(1-naphthylmethyl)carboxyamide]-2'-deoxyuridine
  misc_feature (37)..(37): n is 2'-O-methyl-guanosine
  misc_feature (38)..(38): n is 5-[N-(1-naphthylmethyl)carboxyamide]-2'-deoxyuridine
  misc_feature (39)..(39): n is 2'-O-methyl-adenosine
  misc_feature (40)..(40): n is 2'-O-methyl-guanosine
  misc_feature (43)..(43): n is 5-[N-(1-naphthylmethyl)carboxyamide]-2'-deoxyuridine
  misc_feature (44)..(44): n is 5-[N-(1-naphthylmethyl)carboxyamide]-2'- O-methyl-uridine
  misc_feature (45)..(45): n is 5-[N-(1-naphthylmethyl)carboxyamide]-2'-deoxyuridine
  misc_feature (49)..(49): n is 5-[N-(1-naphthylmethyl)carboxyamide]-2'-deoxyuridine
  misc_feature (50)..(51): n is 2'-O-methyl-guanosine
cgacagcangnangcacancnnccgnnnaanngnnnnnnngannnaaannn

SEQ ID NO: 761 - DNA, 4 bp, Artificial Sequence
  Synthetic
  misc_feature (1)..(1): n is a naturally occurring or modified nucleotide
  misc_feature (2)..(2): n is a modified pyrimidine
nnvs

SEQ ID NO: 762 - DNA, 19 bp, Artificial Sequence
  Synthetic
  misc_feature (1)..(1): n is c or g
  misc_feature (2)..(2): n is c, g or a modified pyrimidine
  misc_feature (3)..(3): n is a modified pyrimidine
  misc_feature (6)..(6): n is a naturally occurring or modified nucleotide
  misc_feature (7)..(7): n is Nm, wherein N is a naturally occurring or modified nucleotide; m is 1 to 20
  misc_feature (11)..(13): n is a modified pyrimidine
  misc_feature (15)..(15): n is a modified pyrimidine
nnnacnngcgnnnanagcg

SEQ ID NO: 763 - DNA, 29 bp, Artificial Sequence
  Synthetic
  misc_feature (1)..(1): 2'-deoxycytidine-3'-phosphorothioate
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ncgnnnaanngnnnnnnngannnaaannn

SEQ ID NO: 764 - DNA, 29 bp, Artificial Sequence
  Synthetic
  misc_feature (2)..(2): 2'-deoxycytidine-3'-phosphorothioate
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
cngnnnaanngnnnnnnngannnaaannn

SEQ ID NO: 765 - DNA, 29 bp, Artificial Sequence
  Synthetic
  misc_feature (3)..(3): 2'-deoxyguanosine-3'-phosphorothioate
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccnnnnaanngnnnnnnngannnaaannn

SEQ ID NO: 766 - DNA, 29 bp, Artificial Sequence
  Synthetic
  misc_feature (4)..(4): 5-[N-(1-naphthylmethyl)carboxyamide]-2'-deoxyuridine-3'-phosphoro thioate
  misc_feature (5)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnaaannn

SEQ ID NO: 767 - DNA, 29 bp, Artificial Sequence
  Synthetic
  misc_feature (4)..(4): 5-[N-(1-naphthylmethyl)carboxyamide]-2'-deoxyuridine
  misc_feature (5)..(5): 5-[N-(1-naphthylmethyl)carboxyamide]-2'-deoxyuridine-3'-phosphoro thioate
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnaaannn

SEQ ID NO: 768 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (7)..(7): 2'-deoxyadenosine-3'-phosphorothioate
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccgnnnnanngnnnnnnngannnaaannn

SEQ ID NO: 769 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (8)..(8): 2'-deoxyadenosine-3'-phosphorothioate
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccgnnnannngnnnnnnngannnaaannn

SEQ ID NO: 770 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (8)..(8): 2'-deoxyadenosine-3'-phosphorothioate
  misc_feature (9)..(9): 2'-O-methyl-guanosine
  misc_feature (10)..(10): 5-[N-(1-naphthylmethyl)carboxyamide]-2'-deoxyuridine-3'-phosphoro thioate
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnaaannn

SEQ ID NO: 771 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (11)..(11): 2'-deoxyguanosine-3'-phosphorothioate
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccgnnnaannnnnnnnnngannnaaannn

SEQ ID NO: 772 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(13): 5-[N-(1-naphthylmethyl)carboxyamide]-2'-deoxyuridine-3'-phosphoro thioate
  misc_feature (14)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnaaannn

SEQ ID NO: 773 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(13): 5-[N-(1-naphthylmethyl)carboxyamide]-2'-deoxyuridine
  misc_feature (14)..(14): 5-[N-(1-naphthylmethyl)carboxyamide]-2'-deoxyuridine-3'-phosphoro thioate
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnaaannn

SEQ ID NO: 774 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine-3'-phosphoro thioate
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnaaannn

SEQ ID NO: 775 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (19)..(19): 2'-deoxyguanosine-3'-phosphorothioate
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnnnannnaaannn

SEQ ID NO: 776 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (20)..(20): 2'-deoxyadenosine-3'-phosphorothioate
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngnnnnaaannn

SEQ ID NO: 777 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine-3'-phosphoro thioate
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnaaannn

SEQ ID NO: 778 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine-3'-phosphoro thioate
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnaaannn

SEQ ID NO: 779 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (24)..(24): 2'-deoxyadenosine-3'-phosphorothioate
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnnaannn

SEQ ID NO: 780 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (25)..(25): 2'-deoxyadenosine-3'-phosphorothioate
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnanannn

SEQ ID NO: 781 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (26)..(26): 2'-deoxyadenosine-3'-phosphorothioate
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnaannnn

SEQ ID NO: 782 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine-3'-phosphoro thioate
  misc_feature (28)..(29): 2'-O-methyl-guanosine
ccgnnnaanngnnnnnnngannnaaannn

SEQ ID NO: 783 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine-3'-phosphorothioate
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 22'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnaaannn

SEQ ID NO: 784 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine-3'-phosphorothioate
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnaaannn

SEQ ID NO: 785 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine-3'-phosphorothioate
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnaaannn

SEQ ID NO: 786 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine-3'-phosphorothioate
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnaaannn

SEQ ID NO: 787 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine-3'-phosphorothioate
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnaaannn

SEQ ID NO: 788 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine-3'-phosphorothioate
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnaaannn

SEQ ID NO: 789 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(28): 2'-O-methyl-guanosine-3'-phosphorothioate
  misc_feature (29)..(29): 2'-O-methyl-guanosine
ccgnnnaanngnnnnnnngannnaaannn

SEQ ID NO: 790 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (27)..(27): 5-[N-(1-naphthylmethyl)carboxyamide]-2'-deoxyuridine
  misc_feature (28)..(28): 2'-O-methyl-guanosine
  misc_feature (29)..(29): 2'-O-methyl-guanosine-3'-phosphorothioate
ccgnnnaanngnnnnnnngannnaaannn

SEQ ID NO: 791 - DNA, 29 bp, Artificial Sequence
  Synthetic
  misc_feature (1)..(1): 2'-O-methyl-cytidine
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (25)..(25): 2'-deoxyadenosine-3'-phosphorothioate
  misc_feature (27)..(27): 5-[N-(1-naphthylmethyl)carboxyamide]-2'-deoxyuridine
  misc_feature (28)..(29): 2'-O-methyl-guanosine
ncgnnnaanngnnnnnnngannnanannn

SEQ ID NO: 792 - DNA, 29 bp, Artificial Sequence
  Synthetic
  misc_feature (1)..(1): 2'-O-methyl-cytidine
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (26)..(26): 2'-deoxyadenosine-3'-phosphorothioate
  misc_feature (27)..(27): 5-[N-(1-naphthylmethyl)carboxyamide]-2'-deoxyuridine
  misc_feature (28)..(29): 2'-O-methyl-guanosine
ncgnnnaanngnnnnnnngannnaannnn

SEQ ID NO: 793 - DNA, 29 bp, Artificial Sequence
  Synthetic
  misc_feature (1)..(1): 2'-O-methyl-cytidine
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (25)..(26): 2'-deoxyadenosine-3'-phosphorothioate
  misc_feature (27)..(27): 5-[N-(1-naphthylmethyl)carboxyamide]-2'-deoxyuridine
  misc_feature (28)..(29): 2'-O-methyl-guanosine
ncgnnnaanngnnnnnnngannnannnnn

SEQ ID NO: 794 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (25)..(26): 2'-deoxyadenosine-3'-phosphorothioate
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnannnnn

SEQ ID NO: 795 - DNA, 29 bp, Artificial Sequence
  Synthetic
  misc_feature (1)..(1): 2'-O-methyl-cytidine
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (24)..(24): 2'-deoxyadenosine-3'-phosphorothioate
  misc_feature (27)..(27): 5-[N-(1-naphthylmethyl)carboxyamide]-2'-deoxyuridine
  misc_feature (28)..(29): 2'-O-methyl-guanosine
ncgnnnaanngnnnnnnngannnnaannn

SEQ ID NO: 796 - DNA, 29 bp, Artificial Sequence
  Synthetic
  misc_feature (1)..(1): 2'-O-methyl-cytidine
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (24)..(25): 2'-deoxyadenosine-3'-phosphorothioate
  misc_feature (27)..(27): 5-[N-(1-naphthylmethyl)carboxyamide]-2'-deoxyuridine
  misc_feature (28)..(29): 2'-O-methyl-guanosine
ncgnnnaanngnnnnnnngannnnnannn

SEQ ID NO: 797 - DNA, 29 bp, Artificial Sequence
  Synthetic
  misc_feature (1)..(1): 2'-O-methyl-cytidine
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (24)..(26): 2'-deoxyadenosine-3'-phosphorothioate
  misc_feature (27)..(27): 5-[N-(1-naphthylmethyl)carboxyamide]-2'-deoxyuridine
  misc_feature (28)..(29): 2'-O-methyl-guanosine
ncgnnnaanngnnnnnnngannnnnnnnn

SEQ ID NO: 798 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (24)..(26): 2'-deoxyadenosine-3'-phosphorothioate
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnnnnnnn

SEQ ID NO: 799 - DNA, 29 bp, Artificial Sequence
  Synthetic
  misc_feature (4)..(5): 5-[N-(1-naphthylmethyl)carboxyamide]-2'-deoxyuridine
  misc_feature (6)..(6): 2'-O-methyl-cytidine
  misc_feature (9)..(9): 2'-O-methyl-guanosine
  misc_feature (10)..(10): 5-[N-(1-naphthylmethyl)carboxyamide]-2'-deoxyuridine
  misc_feature (12)..(12): 2'-O-methyl-cytidine
  misc_feature (13)..(14): 5-[N-(1-naphthylmethyl)carboxyamide]-2'-deoxyuridine
  misc_feature (15)..(15): 2'-O-methyl-guanosine
  misc_feature (16)..(16): 5-[N-(1-naphthylmethyl)carboxyamide]-2'-deoxyuridine
  misc_feature (17)..(17): 2'-O-methyl-adenosine
  misc_feature (18)..(18): 2'-O-methyl-guanosine
  misc_feature (21)..(21): 5-[N-(1-naphthylmethyl)carboxyamide]-2'-deoxyuridine
  misc_feature (22)..(22): 5-[N-(1-naphthylmethyl)carboxyamide]-2'-O-methyl-uridine
  misc_feature (23)..(23): 5-[N-(1-naphthylmethyl)carboxyamide]-2'-deoxyuridine
  misc_feature (24)..(25): 2'-deoxyadenosine-3'-phosphorothioate
  misc_feature (27)..(27): 5-[N-(1-naphthylmethyl)carboxyamide]-2'-deoxyuridine
  misc_feature (28)..(29): 2'-O-methyl-guanosine
ccgnnnaanngnnnnnnngannnnnannn

SEQ ID NO: 800 - DNA, 21 bp, Artificial Sequence
  Synthetic
  misc_feature (1)..(1): 2'-O-methyl-cytidine
  misc_feature (2)..(2): 2'-deoxyguanosine-3'-phosphorothioate
  misc_feature (4)..(4): 2'-O-methyl-cytidine
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine
  misc_feature (11)..(11): 5-[N-(1-naphthylmethyl)carboxyamide]-2'-deoxyuridine
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
nnanannangnannnnnnnnn

SEQ ID NO: 801 - DNA, 21 bp, Artificial Sequence
  Synthetic
  misc_feature (1)..(1): 2'-O-methyl-cytidine
  misc_feature (3)..(3): 2'-deoxyadenosine-3'-phosphorothioate
  misc_feature (4)..(4): 2'-O-methyl-cytidine
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine
  misc_feature (11)..(11): 5-[N-(1-naphthylmethyl)carboxyamide]-2'-deoxyuridine
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
ngnnannangnannnnnnnnn

SEQ ID NO: 802 - DNA, 21 bp, Artificial Sequence
  Synthetic
  misc_feature (1)..(1): 2'-O-methyl-cytidine
  misc_feature (4)..(4): 2'-O-methyl-cytidine
  misc_feature (5)..(5): 2'-deoxyadenosine-3'-phosphorothioate
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine
  misc_feature (11)..(11): 5-[N-(1-naphthylmethyl)carboxyamide]-2'-deoxyuridine
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
ngannnnangnannnnnnnnn

SEQ ID NO: 803 - DNA, 21 bp, Artificial Sequence
  Synthetic
  misc_feature (1)..(1): 2'-O-methyl-cytidine
  misc_feature (4)..(4): 2'-O-methyl-cytidine
  misc_feature (6)..(6): 2'-O-methyl-guanosine
  misc_feature (7)..(7): 2'-O-methyl-cytidine
  misc_feature (8)..(8): 2'-deoxyadenosine-3'-phosphorothioate
  misc_feature (9)..(9): 5-[N-(1-naphthylmethyl)carboxyamide]-2'-deoxyuridine
  misc_feature (11)..(11): 5-[N-(1-naphthylmethyl)carboxyamide]-2'-deoxyuridine
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
nganannnngnannnnnnnnn

SEQ ID NO: 804 - DNA, 21 bp, Artificial Sequence
  Synthetic
  misc_feature (1)..(1): 2'-O-methyl-cytidine
  misc_feature (4)..(4): 2'-O-methyl-cytidine
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine-3'-phosphoro thioate
  misc_feature (11)..(11): 5-[N-(1-naphthylmethyl)carboxyamide]-2'-deoxyuridine
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
nganannangnannnnnnnnn

SEQ ID NO: 805 - DNA, 21 bp, Artificial Sequence
  Synthetic
  misc_feature (1)..(1): 2'-O-methyl-cytidine
  misc_feature (4)..(4): 2'-O-methyl-cytidine
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine
  misc_feature (10)..(10): 2'-deoxyguanosine-3'-phosphorothioate
  misc_feature (11)..(11): 5-[N-(1-naphthylmethyl)carboxyamide]-2'-deoxyuridine
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
nganannannnannnnnnnnn

SEQ ID NO: 806 - DNA, 21 bp, Artificial Sequence
  Synthetic
  misc_feature (1)..(1): 2'-O-methyl-cytidine
  misc_feature (4)..(4): 2'-O-methyl-cytidine
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine
  misc_feature (11)..(11): 5-[N-(1-naphthylmethyl)carboxyamide]-2'-deoxyuridine-3'-phosphoro thioate
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
nganannangnannnnnnnnn

SEQ ID NO: 807 - DNA, 21 bp, Artificial Sequence
  Synthetic
  misc_feature (1)..(1): 2'-O-methyl-cytidine
  misc_feature (4)..(4): 2'-O-methyl-cytidine
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine
  misc_feature (11)..(11): 5-[N-(1-naphthylmethyl)carboxyamide]-2'-deoxyuridine
  misc_feature (12)..(12): 2'-deoxyadenosine-3'-phosphorothioate
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
nganannangnnnnnnnnnnn

SEQ ID NO: 808 - DNA, 21 bp, Artificial Sequence
  Synthetic
  misc_feature (1)..(1): 2'-O-methyl-cytidine
  misc_feature (4)..(4): 2'-O-methyl-cytidine
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine
  misc_feature (11)..(11): 5-[N-(1-naphthylmethyl)carboxyamide]-2'-deoxyuridine
  misc_feature (13)..(13): 5-[N-(1-naphthylmethyl)carboxyamide]-2'-deoxyuridine-3'-phosphoro thioate
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
nganannangnannnnnnnnn

SEQ ID NO: 809 - DNA, 21 bp, Artificial Sequence
  Synthetic
  misc_feature (1)..(1): 2'-O-methyl-cytidine
  misc_feature (4)..(4): 2'-O-methyl-cytidine
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine
  misc_feature (11)..(11): 5-[N-(1-naphthylmethyl)carboxyamide]-2'-deoxyuridine
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine-3'-phosphoro thioate
  misc_feature (20)..(20): 2'-O-methyl-cytidine
  misc_feature (21)..(21): 5-[N-(1-naphthylmethyl)carboxyamide]-2'-O-methyl-uridine
nganannangnannnnnnnnn

SEQ ID NO: 810 - DNA, 21 bp, Artificial Sequence
  Synthetic
  misc_feature (1)..(1): 2'-O-methyl-cytidine-3'-phosphorothioate
  misc_feature (4)..(4): 2'-O-methyl-cytidine
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine
  misc_feature (11)..(11): 5-[N-(1-naphthylmethyl)carboxyamide]-2'-deoxyuridine
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
nganannangnannnnnnnnn

SEQ ID NO: 811 - DNA, 21 bp, Artificial Sequence
  Synthetic
  misc_feature (1)..(1): 2'-O-methyl-cytidine
  misc_feature (4)..(4): 2'-O-methyl-cytidine-3'-phosphorothioate
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine
  misc_feature (11)..(11): 5-[N-(1-naphthylmethyl)carboxyamide]-2'-deoxyuridine
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
nganannangnannnnnnnnn

SEQ ID NO: 812 - DNA, 21 bp, Artificial Sequence
  Synthetic
  misc_feature (1)..(1): 2'-O-methyl-cytidine
  misc_feature (4)..(4): 2'-O-methyl-cytidine
  misc_feature (6)..(6): 2'-O-methyl-guanosine
  misc_feature (7)..(7): 2'-O-methyl-guanosine-3'-phosphorothioate
  misc_feature (9)..(9): 5-[N-(1-naphthylmethyl)carboxyamide]-2'-deoxyuridine
  misc_feature (11)..(11): 5-[N-(1-naphthylmethyl)carboxyamide]-2'-deoxyuridine
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
nganannangnannnnnnnnn

SEQ ID NO: 813 - DNA, 21 bp, Artificial Sequence
  Synthetic
  misc_feature (1)..(1): 2'-O-methyl-cytidine
  misc_feature (4)..(4): 2'-O-methyl-cytidine
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine
  misc_feature (11)..(11): 5-[N-(1-naphthylmethyl)carboxyamide]-2'-deoxyuridine
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine-3'-phosphorothioate
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
nganannangnannnnnnnnn

SEQ ID NO: 814 - DNA, 21 bp, Artificial Sequence
  Synthetic
  misc_feature (1)..(1): 2'-O-methyl-cytidine
  misc_feature (4)..(4): 2'-O-methyl-cytidine
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine
  misc_feature (11)..(11): 5-[N-(1-naphthylmethyl)carboxyamide]-2'-deoxyuridine
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine-3'-phosphorothioate
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
nganannangnannnnnnnnn

SEQ ID NO: 815 - DNA, 21 bp, Artificial Sequence
  Synthetic
  misc_feature (1)..(1): 2'-O-methyl-cytidine
  misc_feature (4)..(4): 2'-O-methyl-cytidine
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine
  misc_feature (11)..(11): 5-[N-(1-naphthylmethyl)carboxyamide]-2'-deoxyuridine
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine-3'-phosphorothioate
  misc_feature (21)..(21): 5-[N-(1-naphthylmethyl)carboxyamide]-2'-O-methyl-uridine
nganannangnannnnnnnnn

SEQ ID NO: 816 - DNA, 21 bp, Artificial Sequence
  Synthetic
  misc_feature (1)..(1): 2'-O-methyl-cytidine
  misc_feature (4)..(4): 2'-O-methyl-cytidine
  misc_feature (6)..(6): 2'-O-methyl-guanosine-3'-phosphorothioate
  misc_feature (7)..(7): 2'-O-methyl-cytidine
  misc_feature (9)..(9): 5-[N-(1-naphthylmethyl)carboxyamide]-2'-deoxyuridine
  misc_feature (11)..(11): 5-[N-(1-naphthylmethyl)carboxyamide]-2'-deoxyuridine
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
nganannangnannnnnnnnn

SEQ ID NO: 817 - DNA, 21 bp, Artificial Sequence
  Synthetic
  misc_feature (1)..(1): 2'-O-methyl-cytidine
  misc_feature (4)..(4): 2'-O-methyl-cytidine
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine
  misc_feature (11)..(11): 5-[N-(1-naphthylmethyl)carboxyamide]-2'-deoxyuridine
  misc_feature (13)..(13): 5-[N-(1-naphthylmethyl)carboxyamide]-2'-deoxyuridine
  misc_feature (14)..(14): 2'-O-methyl-guanosine-3'-phosphorothioate
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
nganannangnannnnnnnnn

SEQ ID NO: 818 - DNA, 21 bp, Artificial Sequence
  Synthetic
  misc_feature (1)..(1): 2'-O-methyl-cytidine
  misc_feature (4)..(4): 2'-O-methyl-cytidine
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine
  misc_feature (11)..(11): 5-[N-(1-naphthylmethyl)carboxyamide]-2'-deoxyuridine
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine-3'-phosphorothioate
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
nganannangnannnnnnnnn

SEQ ID NO: 819 - DNA, 21 bp, Artificial Sequence
  Synthetic
  misc_feature (1)..(1): 2'-O-methyl-cytidine
  misc_feature (4)..(4): 2'-O-methyl-cytidine
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine
  misc_feature (11)..(11): 5-[N-(1-naphthylmethyl)carboxyamide]-2'-deoxyuridine
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine-3'-phosphorothioate
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
nganannangnannnnnnnnn

SEQ ID NO: 820 - DNA, 21 bp, Artificial Sequence
  Synthetic
  misc_feature (1)..(1): 2'-O-methyl-cytidine
  misc_feature (4)..(4): 2'-O-methyl-cytidine
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine-3'-phosphoro thioate
  misc_feature (10)..(10): 2'-deoxyguanosine-3'-phosphorothioate
  misc_feature (11)..(11): 5-[N-(1-naphthylmethyl)carboxyamide]-2'-deoxyuridine-3'-phosphoro thioate
  misc_feature (12)..(12): 2'-deoxyadenosine-3'-phosphorothioate
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
nganannannnnnnnnnnnnn

SEQ ID NO: 821 - DNA, 21 bp, Artificial Sequence
  Synthetic
  misc_feature (1)..(1): 2'-O-methyl-cytidine
  misc_feature (4)..(4): 2'-O-methyl-cytidine-3'-phosphorothioate
  misc_feature (6)..(6): 2'-O-methyl-guanosine
  misc_feature (7)..(7): 2'-O-methyl-cytidine
  misc_feature (9)..(9): 5-[N-(1-naphthylmethyl)carboxyamide]-2'-deoxyuridine-3'-phosphoro thioate
  misc_feature (10)..(10): 2'-deoxyguanosine-3'-phosphorothioate
  misc_feature (11)..(11): 5-[N-(1-naphthylmethyl)carboxyamide]-2'-deoxyuridine-3'-phosphoro thioate
  misc_feature (12)..(12): 2'-deoxyadenosine-3'-phosphorothioate
  misc_feature (13)..(13): 5-[N-(1-naphthylmethyl)carboxyamide]-2'-deoxyuridine
  misc_feature (14)..(14): 2'-O-methyl-guanosine
  misc_feature (15)..(15): 2'-O-methyl-cytidine
  misc_feature (16)..(16): 2'-O-methyl-adenosine
  misc_feature (17)..(17): 2'-O-methyl-cytidine
  misc_feature (18)..(18): 2'-O-methyl-adenosine
  misc_feature (19)..(19): 5-[N-(1-naphthylmethyl)carboxyamide]-2'-deoxyuridine
  misc_feature (20)..(20): 2'-O-methyl-cytidine
  misc_feature (21)..(21): 5-[N-(1-naphthylmethyl)carboxyamide]-2'-O-methyl-uridine
nganannannnnnnnnnnnnn

SEQ ID NO: 822 - DNA, 24 bp, Artificial Sequence
  Synthetic
  misc_feature (1)..(2): 5-(N-benzylcarboxyamide)-2'-deoxyuridine
  misc_feature (3)..(3): 2'-O-methyl-adenosine
  misc_feature (5)..(5): hexaethylene glycol
  misc_feature (7)..(7): 5-(N-benzylcarboxyamide)-2'-O-methyl-uridine
  misc_feature (8)..(8): 5-(N-benzylcarboxyamide)-2'-deoxyuridine
  misc_feature (9)..(9): 2'-O-methyl-adenosine
  misc_feature (11)..(11): 3 carbon spacer
  misc_feature (12)..(12): 2'-O-methyl-cytidine
  misc_feature (13)..(13): 2'-O-methyl-guanosine
  misc_feature (15)..(15): 2'-deoxyguanosine-3'-phosphorothioate
  misc_feature (16)..(16): 5-[N-(1-naphthylmethyl)carboxyamide]-2'-deoxyuridine-3'-phosphoro thioate
  misc_feature (17)..(17): 5-(N-benzylcarboxyamide)-2'-deoxyuridine-3'-phosphorothioate
  misc_feature (18)..(18): 5-(N-benzylcarboxyamide)-2'-O-methyl-uridine
  misc_feature (19)..(19): 2'-O-methyl-adenosine
  misc_feature (20)..(20): 5-(N-benzylcarboxyamide)-2'-deoxyuridine
  misc_feature (21)..(21): 2'-O-methyl-adenosine
  misc_feature (24)..(24): 2'-O-methyl-guanosine
nnncngnnncnnncnnnnnnngcn

SEQ ID NO: 823 - DNA, 24 bp, Artificial Sequence
  Synthetic
  misc_feature (1)..(2): 5-(N-benzylcarboxyamide)-2'-deoxyuridine
  misc_feature (3)..(3): 2'-O-methyl-adenosine
  misc_feature (5)..(5): hexaethylene glycol
  misc_feature (7)..(7): 5-(N-benzylcarboxyamide)-2'-O-methyl-uridine
  misc_feature (8)..(8): 5-(N-benzylcarboxyamide)-2'-deoxyuridine
  misc_feature (9)..(9): 2'-deoxyadenosine-3'-phosphorothioate
  misc_feature (11)..(11): 3 carbon spacer
  misc_feature (12)..(12): 2'-O-methyl-cytidine
  misc_feature (15)..(15): 2'-deoxyguanosine-3'-phosphorothioate
  misc_feature (16)..(16): 5-[N-(1-naphthylmethyl)carboxyamide]-2'-deoxyuridine-3'-phosphoro thioate
  misc_feature (17)..(17): 5-(N-benzylcarboxyamide)-2'-deoxyuridine-3'-phosphorothioate
  misc_feature (18)..(18): 5-(N-benzylcarboxyamide)-2'-O-methyl-uridine
  misc_feature (19)..(19): 2'-O-methyl-adenosine
  misc_feature (20)..(20): 5-(N-benzylcarboxyamide)-2'-deoxyuridine
  misc_feature (21)..(21): 2'-O-methyl-adenosine
  misc_feature (24)..(24): 2'-O-methyl-guanosine
nnncngnnncnngcnnnnnnngcn

SEQ ID NO: 824 - DNA, 24 bp, Artificial Sequence
  Synthetic
  misc_feature (1)..(2): 5-(N-benzylcarboxyamide)-2'-deoxyuridine
  misc_feature (3)..(3): 2'-O-methyl-adenosine
  misc_feature (5)..(5): hexaethylene glycol
  misc_feature (7)..(7): 5-(N-benzylcarboxyamide)-2'-O-methyl-uridine
  misc_feature (8)..(8): 5-(N-benzylcarboxyamide)-2'-deoxyuridine-3'-phosphorothioate
  misc_feature (9)..(9): 2'-deoxyadenosine-3'-phosphorothioate
  misc_feature (11)..(11): 3 carbon spacer
  misc_feature (12)..(12): 2'-O-methyl-cytidine
  misc_feature (13)..(13): 2'-O-methyl-guanosine
  misc_feature (15)..(15): 2'-deoxyguanosine-3'-phosphorothioate
  misc_feature (16)..(16): 5-[N-(1-naphthylmethyl)carboxyamide]-2'-deoxyuridine-3'-phosphoro thioate
  misc_feature (17)..(17): 5-(N-benzylcarboxyamide)-2'-deoxyuridine-3'-phosphorothioate
  misc_feature (18)..(18): 5-(N-benzylcarboxyamide)-2'-O-methyl-uridine
  misc_feature (19)..(19): 2'-O-methyl-adenosine
  misc_feature (20)..(20): 5-(N-benzylcarboxyamide)-2'-deoxyuridine
  misc_feature (21)..(21): 2'-O-methyl-adenosine
  misc_feature (24)..(24): 2'-O-methyl-guanosine
nnncngnnncnnncnnnnnnngcn

SEQ ID NO: 825 - DNA, 24 bp, Artificial Sequence
  Synthetic
  misc_feature (1)..(2): 5-(N-benzylcarboxyamide)-2'-deoxyuridine
  misc_feature (3)..(3): 2'-O-methyl-adenosine
  misc_feature (5)..(5): hexaethylene glycol
  misc_feature (7)..(7): 5-(N-benzylcarboxyamide)-2'-O-methyl-uridine
  misc_feature (8)..(8): 5-(N-benzylcarboxyamide)-2'-deoxyuridine-3'-phosphorothioate
  misc_feature (9)..(9): 2'-deoxyadenosine-3'-phosphorothioate
  misc_feature (11)..(11): 3 carbon spacer
  misc_feature (12)..(12): 2'-O-methyl-cytidine
  misc_feature (15)..(15): 2'-deoxyguanosine-3'-phosphorothioate
  misc_feature (16)..(16): 5-[N-(1-naphthylmethyl)carboxyamide]-2'-deoxyuridine-3'-phosphoro thioate
  misc_feature (17)..(17): 5-(N-benzylcarboxyamide)-2'-deoxyuridine-3'-phosphorothioate
  misc_feature (18)..(18): 5-(N-benzylcarboxyamide)-2'-O-methyl-uridine
  misc_feature (19)..(19): 2'-O-methyl-adenosine
  misc_feature (20)..(20): 5-(N-benzylcarboxyamide)-2'-deoxyuridine
  misc_feature (21)..(21): 2'-O-methyl-adenosine
  misc_feature (24)..(24): 2'-O-methyl-guanosine
nnncngnnncnngcnnnnnnngcn

SEQ ID NO: 826 - DNA, 24 bp, Artificial Sequence
  Synthetic
  misc_feature (1)..(2): 5-(N-benzylcarboxyamide)-2'-deoxyuridine
  misc_feature (3)..(3): 2'-O-methyl-adenosine
  misc_feature (4)..(4): 2'-deoxycytidine-3'-phosphorothioate
  misc_feature (5)..(5): hexaethylene glycol
  misc_feature (7)..(7): 5-(N-benzylcarboxyamide)-2'-O-methyl-uridine
  misc_feature (8)..(8): 5-(N-benzylcarboxyamide)-2'-deoxyuridine-3'-phosphorothioate
  misc_feature (9)..(9): 2'-deoxyadenosine-3'-phosphorothioate
  misc_feature (10)..(10): 2'-deoxycytidine-3'-phosphorothioate
  misc_feature (11)..(11): 3 carbon spacer
  misc_feature (12)..(12): 2'-O-methyl-cytidine
  misc_feature (13)..(13): 2'-O-methyl-guanosine
  misc_feature (15)..(15): 2'-deoxyguanosine-3'-phosphorothioate
  misc_feature (16)..(16): 5-[N-(1-naphthylmethyl)carboxyamide]-2'-deoxyuridine-3'-phosphoro thioate
  misc_feature (17)..(17): 5-(N-benzylcarboxyamide)-2'-deoxyuridine-3'-phosphorothioate
  misc_feature (18)..(18): 5-(N-benzylcarboxyamide)-2'-O-methyl-uridine-3'-phosphorothioate
  misc_feature (19)..(19): 2'-O-methyl-adenosine
  misc_feature (20)..(20): 5-(N-benzylcarboxyamide)-2'-deoxyuridine
  misc_feature (21)..(21): 2'-O-methyl-adenosine
  misc_feature (24)..(24): 2'-O-methyl-guanosine
nnnnngnnnnnnncnnnnnnngcn

SEQ ID NO: 827 - DNA, 24 bp, Artificial Sequence
  Synthetic
  misc_feature (1)..(2): 5-(N-benzylcarboxyamide)-2'-deoxyuridine
  misc_feature (3)..(3): 2'-O-methyl-adenosine
  misc_feature (4)..(4): 2'-deoxycytidine-3'-phosphorothioate
  misc_feature (5)..(5): hexaethylene glycol
  misc_feature (7)..(7): 5-(N-benzylcarboxyamide)-2'-O-methyl-uridine
  misc_feature (8)..(8): 5-(N-benzylcarboxyamide)-2'-deoxyuridine-3'-phosphorothioate
  misc_feature (9)..(9): 2'-deoxyadenosine-3'-phosphorothioate
  misc_feature (10)..(10): 2'-deoxycytidine-3'-phosphorothioate
  misc_feature (11)..(11): 3 carbon spacer
  misc_feature (12)..(12): 2'-O-methyl-cytidine
  misc_feature (13)..(13): 2'-O-methyl-guanosine
  misc_feature (14)..(14): 2'-deoxycytidine-3'-phosphorothioate
  misc_feature (15)..(15): 2'-deoxyguanosine-3'-phosphorothioate
  misc_feature (16)..(16): 5-[N-(1-naphthylmethyl)carboxyamide]-2'-deoxyuridine-3'-phosphoro thioate
  misc_feature (17)..(17): 5-(N-benzylcarboxyamide)-2'-deoxyuridine-3'-phosphorothioate
  misc_feature (18)..(18): 5-(N-benzylcarboxyamide)-2'-O-methyl-uridine-3'-phosphorothioate
  misc_feature (19)..(19): 2'-O-methyl-adenosine
  misc_feature (20)..(20): 5-(N-benzylcarboxyamide)-2'-deoxyuridine
  misc_feature (21)..(21): 2'-O-methyl-adenosine
  misc_feature (24)..(24): 2'-O-methyl-guanosine
nnnnngnnnnnnnnnnnnnnngcn

SEQ ID NO: 828 - DNA, 24 bp, Artificial Sequence
  Synthetic
  misc_feature (1)..(2): 5-(N-benzylcarboxyamide)-2'-deoxyuridine
  misc_feature (3)..(3): 2'-O-methyl-adenosine
  misc_feature (5)..(5): hexaethylene glycol
  misc_feature (7)..(7): 5-(N-benzylcarboxyamide)-2'-O-methyl-uridine
  misc_feature (8)..(8): 5-(N-benzylcarboxyamide)-2'-deoxyuridine-3'-phosphorothioate
  misc_feature (9)..(9): 2'-deoxyadenosine-3'-phosphorothioate
  misc_feature (10)..(10): 2'-deoxycytidine-3'-phosphorothioate
  misc_feature (11)..(11): 3 carbon spacer
  misc_feature (12)..(12): 2'-O-methyl-cytidine
  misc_feature (13)..(13): 2'-O-methyl-guanosine
  misc_feature (15)..(15): 2'-deoxyguanosine-3'-phosphorothioate
  misc_feature (16)..(16): 5-[N-(1-naphthylmethyl)carboxyamide]-2'-deoxyuridine-3'-phosphoro thioate
  misc_feature (17)..(17): 5-(N-benzylcarboxyamide)-2'-deoxyuridine-3'-phosphorothioate
  misc_feature (18)..(18): 5-(N-benzylcarboxyamide)-2'-O-methyl-uridine
  misc_feature (19)..(19): 2'-O-methyl-adenosine
  misc_feature (20)..(20): 5-(N-benzylcarboxyamide)-2'-deoxyuridine
  misc_feature (21)..(21): 2'-O-methyl-adenosine
  misc_feature (24)..(24): 2'-O-methyl-guanosine
nnncngnnnnnnncnnnnnnngcn

SEQ ID NO: 829 - DNA, 24 bp, Artificial Sequence
  Synthetic
  misc_feature (1)..(1): 5-(N-benzylcarboxyamide)-2'-deoxyuridine
  misc_feature (2)..(2): 5-(N-3,4-methylenedioxybenzylcarboxyamide)-2'-deoxyuridine
  misc_feature (3)..(3): 2'-O-methyl-adenosine
  misc_feature (5)..(5): hexaethylene glycol
  misc_feature (7)..(7): 5-(N-benzylcarboxyamide)-2'-O-methyl-uridine
  misc_feature (8)..(8): 5-(N-benzylcarboxyamide)-2'-deoxyuridine
  misc_feature (11)..(11): 3 carbon spacer
  misc_feature (12)..(12): 2'-O-methyl-cytidine
  misc_feature (15)..(15): 2'-O-methyl-guanosine
  misc_feature (16)..(16): 5-(N-isobutylcarboxyamide)-2'-deoxyuridine
  misc_feature (17)..(17): 5-(N-benzylcarboxyamide)-2'-deoxyuridine
  misc_feature (18)..(18): 5-(N-benzylcarboxyamide)-2'-O-methyl-uridine
  misc_feature (19)..(19): 2'-O-methyl-adenosine
  misc_feature (20)..(20): 5-(N-benzylcarboxyamide)-2'-deoxyuridine
  misc_feature (21)..(21): 2'-O-methyl-adenosine
  misc_feature (24)..(24): 2'-O-methyl-guanosine
nnncngnnacnngcnnnnnnngcn

SEQ ID NO: 830 - DNA, 21 bp, Artificial Sequence
  Synthetic
  misc_feature (9)..(9): C-5 modified pyrimidine
  misc_feature (11)..(11): C-5 modified pyrimidine
  misc_feature (13)..(13): C-5 modified pyrimidine
  misc_feature (19)..(19): C-5 modified pyrimidine
  misc_feature (21)..(21): C-5 modified pyrimidine
cgacagcangnangcacancn

SEQ ID NO: 831 - DNA, 29 bp, Artificial Sequence
  Synthetic
  misc_feature (4)..(5): C-5 modified pyrimidine
  misc_feature (10)..(10): C-5 modified pyrimidine
  misc_feature (13)..(14): C-5 modified pyrimidine
  misc_feature (16)..(16): C-5 modified pyrimidine
  misc_feature (21)..(23): C-5 modified pyrimidine
  misc_feature (27)..(27): C-5 modified pyrimidine
ccgnncaagngcnngnaggannnaaangg

SEQ ID NO: 832 - DNA, 24 bp, Artificial Sequence
  Synthetic
  misc_feature (1)..(2): PedU, ThdU, 5-(N-[1-(3-trimethylamonium) propyl]carboxyamide)-2'-dU, 2NapdU, 2'-O-methyl 2NapdU, MBndU, or 5-(N-[1-(2,3-dihydroxypropyl)]carboxyamide)-2'-dU, (BndU, NapdU, iBudU, TrpdU), or 2'-O-methyl or 2'-fluoro thereof
  misc_feature (5)..(5): hexaethylene glycol
  misc_feature (7)..(8): PedU, ThdU, 5-(N-[1-(3-trimethylamonium) propyl]carboxyamide)-2'-dU, 2NapdU, 2'-O-methyl 2NapdU, MBndU, or 5-(N-[1-(2,3-dihydroxypropyl)]carboxyamide)-2'-dU, (BndU, NapdU, iBudU, TrpdU), or 2'-O-methyl or 2'-fluoro thereof
  misc_feature (11)..(11): 3 carbon spacer
  misc_feature (16)..(16): PedU, ThdU, 5-(N-[1-(3-trimethylamonium) propyl]carboxyamide)-2'-dU, 2NapdU, 2'-O-methyl 2NapdU, MBndU, or 5-(N-[1-(2,3-dihydroxypropyl)]carboxyamide)-2'-dU, (BndU, NapdU, iBudU, TrpdU), or 2'-O-methyl or 2'-fluoro thereof
  misc_feature (17)..(18): PedU, ThdU, 5-(N-[1-(3-trimethylamonium) propyl]carboxyamide)-2'-dU, 2NapdU, 2'-O-methyl 2NapdU, MBndU, or 5-(N-[1-(2,3-dihydroxypropyl)]carboxyamide)-2'-dU, (BndU, NapdU, iBudU, TrpdU), or 2'-O-methyl or 2'-fluoro thereof
  misc_feature (20)..(20): PedU, ThdU, 5-(N-[1-(3-trimethylamonium) propyl]carboxyamide)-2'-dU, 2NapdU, 2'-O-methyl 2NapdU, MBndU, or 5-(N-[1-(2,3-dihydroxypropyl)]carboxyamide)-2'-dU, (BndU, NapdU, iBudU, TrpdU), or 2'-O-methyl or 2'-fluoro thereof
nnacngnnacncgcgnnnanagcg

SEQ ID NO: 833 - DNA, 21 bp, Artificial Sequence
  Synthetic
  misc_feature (1)..(1): selected from the group consisting of a cytidine, a deoxycytidine and a 2'-O-methylcytidine
  misc_feature (4)..(4): a cytidine, a cytidine comprising a phosphorothioate linkage, a deoxycytidine, a deoxycytidine comprising a phosphorothioate linkage, a 2'-O-methylcytidine or a 2'-O-methylcytidine comprising a phosphorothioate linkage
  misc_feature (6)..(6): selected from the group consisting of a guanosine, a deoxyguanosine and a 2'-O-methylguanosine
  misc_feature (7)..(7): selected from the group consisting of a cytidine, a deoxycytidine and a 2'-O-methylcytidine
  misc_feature (9)..(9): a uridine, a uridine comprising a phosphorothioate linkage, a deoxyuridine, a deoxyuridine comprising a phosphorothioate linkage, a NapdU or  a NapdU comprising a phosphorothioate linkage
  misc_feature (10)..(10): selected from the group consisting of a guanosine, a guanosine comprising a phosphorothioate linkage, a deoxyguanosine and a deoxyguanosine comprising a phosphorothioate linkage
  misc_feature (11)..(11): a uridine, a uridine comprising a phosphorothioate linkage, a deoxyuridine, a deoxyuridine comprising a phosphorothioate linkage, a NapdU or  a NapdU comprising a phosphorothioate linkage
  misc_feature (12)..(12): selected from the group consisting of an adenosine, an adenosine comprising a phosphorothioate linkage, a deoxyadenosine and a deoxyadenosine comprising a phosphorothioate linkage
  misc_feature (13)..(13): selected from the group consisted of a uridine, a deoxyuridine and a 5-(N-naphthylmethylcarboxyamide)-2'-deoxyuridine (NapdU)
  misc_feature (14)..(14): selected from the group consisting of a guanosine, a deoxyguanosine and a 2'-O-methylguanosine
  misc_feature (15)..(15): selected from the group consisting of a cytidine, a deoxycytidine and a 2'-O-methylcytidine
  misc_feature (16)..(16): selected from the group consisting of an adenosine, a deoxyadenosine and a 2'-O-methyladenosine
  misc_feature (17)..(17): selected from the group consisting of a cytidine, a deoxycytidine and a 2'-O-methylcytidine
  misc_feature (18)..(18): selected from the group consisting of an adenosine, a deoxyadenosine and a 2'-O-methyladenosine
  misc_feature (19)..(19): selected from the group consisted of a uridine, a deoxyuridine and a 5-(N-naphthylmethylcarboxyamide)-2'-deoxyuridine (NapdU)
  misc_feature (20)..(20): selected from the group consisting of a cytidine, a deoxycytidine and a 2'-O-methylcytidine
  misc_feature (21)..(21): a uridine, a deoxyuridine, a 2'-O-methyluridine, a 5-(N-naphthylmethylcarboxyamide)-2'-deoxyuridine (NapdU) or a NapdU comprising a 2'-O-methyl group
nganannannnnnnnnnnnnn

SEQ ID NO: 834 - DNA, 29 bp, Artificial Sequence
  Synthetic
  misc_feature (1)..(1): selected from the group consisting of a cytidine, a deoxycytidine and a 2'-O-methylcytidine
  misc_feature (4)..(5): selected from the group consisted of a uridine, a deoxyuridine and a 5-(N-naphthylmethylcarboxyamide)-2'-deoxyuridine (NapdU)
  misc_feature (6)..(6): selected from the group consisting of a cytidine, a deoxycytidine and a 2'-O-methylcytidine
  misc_feature (9)..(9): selected from the group consisting of a guanosine, a deoxyguanosine and a 2'-O-methylguanosine
  misc_feature (10)..(10): selected from the group consisted of a uridine, a deoxyuridine and a 5-(N-naphthylmethylcarboxyamide)-2'-deoxyuridine (NapdU)
  misc_feature (12)..(12): selected from the group consisting of a cytidine, a deoxycytidine and a 2'-O-methylcytidine
  misc_feature (13)..(14): selected from the group consisted of a uridine, a deoxyuridine and a 5-(N-naphthylmethylcarboxyamide)-2'-deoxyuridine (NapdU)
  misc_feature (15)..(15): selected from the group consisting of a guanosine, a deoxyguanosine and a 2'-O-methylguanosine
  misc_feature (16)..(16): selected from the group consisted of a uridine, a deoxyuridine and a 5-(N-naphthylmethylcarboxyamide)-2'-deoxyuridine (NapdU)
  misc_feature (17)..(17): selected from the group consisting of an adenosine, a deoxyadenosine and a 2'-O-methyladenosine
  misc_feature (18)..(18): selected from the group consisting of a guanosine, a deoxyguanosine and a 2'-O-methylguanosine
  misc_feature (21)..(21): selected from the group consisted of a uridine, a deoxyuridine and a 5-(N-naphthylmethylcarboxyamide)-2'-deoxyuridine (NapdU)
  misc_feature (22)..(22): a uridine, a deoxyuridine, a 2'-O-methyluridine, a NapdU or  a NapdU comprising a 2'-O-methyl group
  misc_feature (23)..(23): selected from the group consisted of a uridine, a deoxyuridine and a 5-(N-naphthylmethylcarboxyamide)-2'-deoxyuridine (NapdU)
  misc_feature (24)..(26): selected from the group consisting of an adenosine, an adenosine comprising a phosphorothioate linkage, a deoxyadenosine and a deoxyadenosine comprising a phosphorothioate linkage
  misc_feature (27)..(27): selected from the group consisted of a uridine, a deoxyuridine and a 5-(N-naphthylmethylcarboxyamide)-2'-deoxyuridine (NapdU)
  misc_feature (28)..(29): selected from the group consisting of a guanosine, a deoxyguanosine and a 2'-O-methylguanosine
ncgnnnaanngnnnnnnngannnnnnnnn

SEQ ID NO: 835 - DNA, 24 bp, Artificial Sequence
  Synthetic
  misc_feature (1)..(1): selected from the group consisting of a uridine, a deoxyuridine, a NapdU, a 2NapdU, a BndU and a MBndU
  misc_feature (2)..(2): selected from the group consisting of a uridine, a deoxyuridine, a 5-(N-benzylcarboxyamide)-2?-deoxyuridine (BndU) and a 5-(N-3,4-methylenedioxybenzylcarboxyamide)-2'-deoxyuridine (MBndU)
  misc_feature (3)..(3): selected from the group consisting of an adenosine, a deoxyadenosine and a 2'-O-methyladenosine
  misc_feature (5)..(5): hexaethylene glycol
  misc_feature (7)..(7): a uridine, a deoxyuridine, a 2'-O-methyluridine, a NapdU, a 2'-O-methyl NapdU, a BndU, a 2'-O-methyl BndU, a MBndU or a 2'-O-methyl MBndU
  misc_feature (8)..(8): a uridine, a deoxyuridine, a NapdU, a BndU, a MBndU, or derivative thereof comprising a phosphorothioate linkage
  misc_feature (9)..(9): selected from the group consisting of an adenosine, an adenosine comprising a phosphorothioate linkage, a deoxyadenosine and a deoxyadenosine comprising a phosphorothioate linkage
  misc_feature (11)..(11): 3 carbon spacer
  misc_feature (12)..(12): selected from the group consisting of a cytidine, a deoxycytidine and a 2'-O-methylcytidine
  misc_feature (13)..(13): selected from the group consisting of a guanosine, a deoxyguanosine and a 2'-O-methylguanosine
  misc_feature (15)..(15): selected from the group consisting of a guanosine, a guanosine comprising a phosphorothioate linkage, a deoxyguanosine and a deoxyguanosine comprising a phosphorothioate linkage
  misc_feature (16)..(16): a uridine, a deoxyuridine, a BndU, a 2NapdU, a NapdU,  or derivative thereof comprising a phosphorothioate linkage
  misc_feature (17)..(17): a uridine, a deoxyuridine, a NapdU, a BndU, a MBndU, or derivative thereof comprising a phosphorothioate linkage
  misc_feature (18)..(18): a uridine, a deoxyuridine, a 2'-O-methyluridine, a NapdU, a 2'-O-methyl NapdU, a BndU, a 2'-O-methyl BndU, a MBndU or a 2'-O-methyl MBndU
  misc_feature (19)..(19): selected from the group consisting of an adenosine, a deoxyadenosine and a 2'-O-methyladenosine
  misc_feature (20)..(20): selected from the group consisting of a uridine, a deoxyuridine, a NapdU, a 2NapdU, a BndU and a MBndU
  misc_feature (21)..(21): selected from the group consisting of an adenosine, a deoxyadenosine and a 2'-O-methyladenosine
  misc_feature (24)..(24): selected from the group consisting of a guanosine, a deoxyguanosine and a 2'-O-methylguanosine
nnncngnnncnnncnnnnnnngcn

SEQ ID NO: 836 - DNA, 29 bp, Artificial Sequence
  Synthetic
  misc_feature (4)..(5): selected from the group consisted of a uridine, a deoxyuridine and a 5-(N-naphthylmethylcarboxyamide)-2'-deoxyuridine (NapdU)
  misc_feature (6)..(6): selected from the group consisting of a cytidine, a deoxycytidine and a 2'-O-methylcytidine
  misc_feature (9)..(9): selected from the group consisting of a guanosine, a deoxyguanosine and a 2'-O-methylguanosine
  misc_feature (10)..(10): selected from the group consisted of a uridine, a deoxyuridine and a 5-(N-naphthylmethylcarboxyamide)-2'-deoxyuridine (NapdU)
  misc_feature (12)..(12): selected from the group consisting of a cytidine, a deoxycytidine and a 2'-O-methylcytidine
  misc_feature (13)..(14): selected from the group consisted of a uridine, a deoxyuridine and a 5-(N-naphthylmethylcarboxyamide)-2'-deoxyuridine (NapdU)
  misc_feature (15)..(15): selected from the group consisting of a guanosine, a deoxyguanosine and a 2'-O-methylguanosine
  misc_feature (16)..(16): selected from the group consisted of a uridine, a deoxyuridine and a 5-(N-naphthylmethylcarboxyamide)-2'-deoxyuridine (NapdU)
  misc_feature (17)..(17): selected from the group consisting of an adenosine, a deoxyadenosine and a 2'-O-methyladenosine
  misc_feature (18)..(18): selected from the group consisting of a guanosine, a deoxyguanosine and a 2'-O-methylguanosine
  misc_feature (21)..(21): selected from the group consisted of a uridine, a deoxyuridine and a 5-(N-naphthylmethylcarboxyamide)-2'-deoxyuridine (NapdU)
  misc_feature (22)..(22): selected from the group consisted of a uridine, a deoxyuridine, a 2'-O-methyluridine, a NapdU and  a NapdU comprising a 2'-O-methyl group
  misc_feature (23)..(23): selected from the group consisted of a uridine, a deoxyuridine and a 5-(N-naphthylmethylcarboxyamide)-2'-deoxyuridine (NapdU)
  misc_feature (24)..(26): selected from the group consisting of an adenosine, an adenosine comprising a phosphorothioate linkage, a deoxyadenosine and a deoxyadenosine comprising a phosphorothioate linkage
  misc_feature (27)..(27): selected from the group consisted of a uridine, a deoxyuridine and a 5-(N-naphthylmethylcarboxyamide)-2'-deoxyuridine (NapdU)
  misc_feature (28)..(29): selected from the group consisting of a guanosine, a deoxyguanosine and a 2'-O-methylguanosine
ccgnnnaanngnnnnnnngannnnnnnnn

SEQ ID NO: 837 - DNA, 17 bp, Artificial Sequence
  Synthetic
cgccctcgtcccatctc

SEQ ID NO: 838 - DNA, 18 bp, Artificial Sequence
  Synthetic
cgttctcggttggtgttc

SEQ ID NO: 839 - DNA, 17 bp, Artificial Sequence
  Synthetic
  misc_feature (1)..(1): modified pyrimidine
  misc_feature (4)..(4): Any naturally occurring or modified nucleotide
  misc_feature (9)..(11): modified pyrimidine
  misc_feature (13)..(13): modified pyrimidine
nacncgcgnnnanagcg

SEQ ID NO: 840 - protein, 160 aa, Homo Sapiens
SLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 841 - protein, 125 aa, Homo sapiens
SIEEAVPAVCKTRTVIYEIPRSQVDPTSANFLIWPPCVEVKRCTGCCNTSSVKCQPSRVHHRSVKVAKVEYVRKKPKLKEVQVRLEEHLECACATTSLNPDYREEDTGRPRESGKKRKRKRLKPT

SEQ ID NO: 842 - protein, 111 aa, Homo sapiens
VVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 843 - protein, 121 aa, Homo sapiens
SYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 844 - DNA, 16 bp, Artificial Sequence
  Synthetic
gccacaccctgccctc

SEQ ID NO: 845 - DNA, 18 bp, Artificial Sequence
  Synthetic
gaggacacagacagacac

SEQ ID NO: 846 - DNA, 29 bp, Artificial Sequence
  Description of Artificial Sequence: Synthetic oligonucleotide
  modified_base (4)..(5): n is 5-[N-(1-naphthylmethyl)carboxyamide]-2'-deoxyuridine
  modified_base (10)..(10): n is 5-[N-(1-naphthylmethyl)carboxyamide]-2'-deoxyuridine
  modified_base (13)..(14): n is 5-[N-(1-naphthylmethyl)carboxyamide]-2'-deoxyuridine
  modified_base (16)..(16): n is 5-[N-(1-naphthylmethyl)carboxyamide]-2'-deoxyuridine
  modified_base (21)..(23): n is 5-[N-(1-naphthylmethyl)carboxyamide]-2'-deoxyuridine
  modified_base (27)..(27): n is 5-[N-(1-naphthylmethyl)carboxyamide]-2'-deoxyuridine
ccgnncaagngcnngnaggannnaaangg

What is claimed is:

1. A nucleic acid molecule comprising the nucleic sequence
5'-C$^1$-G-A-C$^{1,2}$-A-G$^1$-C$^1$-A-Z$^2$-G$^2$-Z$^2$-A$^2$-Z-G$^1$-C$^1$-A$^1$-C$^1$-A$^1$-Z-C$^1$-Z$^1$-3' (SEQ ID NO: 833),
wherein, C$^1$ is independently, for each occurrence, selected from the group consisting of a cytidine, a deoxycytidine and a 2'-O-methylcytidine;

C$^{1,2}$ is independently, for each occurrence, selected from the group consisting of a cytidine, a cytidine comprising a phosphorothioate linkage, a deoxycytidine, a deoxycytidine comprising a phosphorothioate linkage, a 2'-O-methylcytidine and a 2'-O-methylcytidine comprising a phosphorothioate linkage;

G$^1$ is independently, for each occurrence, selected from the group consisting of a guanosine, a deoxyguanosine and a 2'-O-methylguanosine;

G$^2$ is independently, for each occurrence, selected from the group consisting of a guanosine, a guanosine comprising a phosphorothioate linkage, a deoxyguanosine and a deoxyguanosine comprising a phosphorothioate linkage;

Z$^1$ is independently, for each occurrence, selected from the group consisting of a uridine, a deoxyuridine, a 2'-O-methyluridine, a 5-(N-naphthylmethylcarboxyamide)-2'-deoxyuridine (NapdU) and a 5-(N-naphthylmethylcarboxyamide)-2'-deoxyuridine (NapdU) comprising a 2'-O-methyl group;

Z$^2$ is independently, for each occurrence, selected from the group consisting of a uridine, a uridine comprising a phosphorothioate linkage, a deoxyuridine, a deoxyuridine comprising a phosphorothioate linkage, a 5-(N-naphthylmethylcarboxyamide)-2'-deoxyuridine (NapdU) and a 5-(N-naphthylmethylcarboxyamide)-2'-deoxyuridine (NapdU) comprising a phosphorothioate linkage;

Z is independently, for each occurrence, selected from the group consisting of a uridine, a deoxyuridine and a 5-(N-naphthylmethylcarboxyamide)-2'-deoxyuridine (NapdU);

$A^1$ is independently, for each occurrence, selected from the group consisting of an adenosine, a deoxyadenosine and a 2'-O-methyladenosine;

$A^2$ is independently, for each occurrence, selected from the group consisting of an adenosine, an adenosine comprising a phosphorothioate linkage, a deoxyadenosine and a deoxyadenosine comprising a phosphorothioate linkage; and wherein, the nucleic acid molecule comprises at least one, two, three, four or five phosphorothioate linkages.

2. The nucleic acid molecule of claim 1, wherein $C^{1,2}$ is a 2'-O-methylcytidine comprising a phosphorothioate linkage.

3. The nucleic acid molecule of claim 1 wherein $Z^1$ is a 5-(N-naphthylmethylcarboxyamide)-2'-deoxyuridine (NapdU) comprising a 2'-O-methyl group; and/or $Z^2$ is a 5-(N-naphthylmethylcarboxyamide)-2'-deoxyuridine (NapdU) comprising a phosphorothioate linkage; and/or Z is a 5-(N-naphthylmethylcarboxyamide)-2'-deoxyuridine (NapdU); and/or $C^1$ is a 2'-O-methylcytidine; and/or $G^1$ is a 2'-O-methylguanosine; and/or $G^2$ is a deoxyguanosine comprising a phosphorothioate linkage; and/or $A^1$ is a 2'-O-methyladenosine; and/or $A^2$ is a deoxyadenosine comprising a phosphorothioate linkage.

* * * * *